United States Patent 12,630,845 (AAV CAPSID VARIANTS FOR TARGETING HUMAN GLIOBLASTOMA CELLS) - sequence listing, part 2

SEQ ID NO: 4155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGLNTISGLRFSQAGASDIRDQSRNWLPGPCYRQQRVSTQSTGNNNSDFSWTGATKYHLNGRDSLVNPGPAMASHKDDDDRFFPQSGVLIFGKESSSGNDIEIDQVMITDEEEIRTTNPVATEQYGSVSTNLQAGNAQAATADVN

SEQ ID NO: 4156 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4157 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKANTAAANSTVT

SEQ ID NO: 4158 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNSSGHPTHSGLKFSQAGASDIRDQSRNWLPGPCYRQQRVSTTPADNNNSDFSWTGATKYHLNGRDSLVNPGPAMASHKDDDEKFFPQSGVLIFGKQNGERGDVDIDGVMITDEEEIRTTNPVATEQYGSVSTNLQAGNAQAATADVN

SEQ ID NO: 4159 - protein, 334 aa, Artificial Sequence; identical to SEQ ID NO: 3721
  Synthetic

SEQ ID NO: 4160 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGPNTLSRLHFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 4161 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGASETNVEIDKVMITDEEEIRTTNPVATEQYGSVSTNLQAGNAQAATADVN

SEQ ID NO: 4162 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGNTTISALKFSQAGASDIRDQSRNWLPGPCYRQQRVSKKYTDNNNSNFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4163 - protein, 334 aa, Artificial Sequence; identical to SEQ ID NO: 572
  Synthetic

SEQ ID NO: 4164 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSEKTNVDIEKVMITDEEEIRTTNPVATEQYGSVSTNLQAGNAQAATADVN

SEQ ID NO: 4165 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGKFFPQSGVLIFGKEGARKTNIDIDEVMITDEEEIRTTNPVATEQYGSVSTNLQAGNAQAATADVN

SEQ ID NO: 4166 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQNGEKGNIDIEGVMITDEEEIRTTNPVATEQYGSVSTNLQAGNAQAATADVN

SEQ ID NO: 4167 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGIQTMSNLRFSQAGASDIRDQSRNWLPGPCYRQQRVSKTAADNNNSDFSWTGATKYHLNGRDSLVNPGPAMASHKDDDGKFFPQSGVLIFGKEGGRKDDVEIGEVMITDEEEIRTTNPVATEQYGSVSTNLQAGNAQAATADVN

SEQ ID NO: 4168 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGPETTSGLRFSQAGASDIRDQSRNWLPGPCYRQQRVSKTSADNNNSEYSWTGATKYHLNGRDSLVNPGPAMASHGDDADKFFPQSGVLIFGKQGSGKSDIDFDEVMITDEEEIRTTNPVATEQYGSVSTNLQAGNAQAATADVN

SEQ ID NO: 4169 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDEEKFFPQSGVLIFGKEDANGTNVEVDRVMITDEEEIRTTNPVATEQYGSVSTNLQAGNAQAATADVN

SEQ ID NO: 4170 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTHNHNNNSEFSWTGATTYHLNGRDSLVNPGPAMASHKDDDDKFFPQSGVLIFGKESGTANDVDIDRVMITDEEEIRTTNPVATEQYGSVSTNLQAGNAQAATADVN

SEQ ID NO: 4171 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGNTTTSPLLFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4172 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWPGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 4173 - protein, 334 aa, Artificial Sequence; identical to SEQ ID NO: 3662
  Synthetic

SEQ ID NO: 4174 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKQGATRNNADFDRVMITDEEEIRTTNPVATEQYGSVSTNLQAGNAQAATADVN

SEQ ID NO: 4175 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDESGTTTNSRLGFSQAGASDIRDQSRNWLPGPCYRQQRVSKQDAENNNSDFSWTGATTYHLNGRDSLVNPGPAMASHKDDEEKFFPQSGVLIFGKQDSEGANVEVGDVMITDEEEIRTTNPVATEQYGSVSTNLQAGNAQAATADVN

SEQ ID NO: 4176 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQNSGKGNVAIDRVMITDEEEIRTTNPVATEQYGSVSTNLQAGNAQAATADVN

SEQ ID NO: 4177 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQSASKNNIAIEEVMITDEEEIRTTNPVATEQYGSVSTNLQAGNAQAATADVN

SEQ ID NO: 4178 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4179 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTHNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 4180 - protein, 334 aa, Artificial Sequence; identical to SEQ ID NO: 2872
  Synthetic

SEQ ID NO: 4181 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQTQKSEAAFRTVH

SEQ ID NO: 4182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 4183 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDAGKFFPQSGVLIFGKQSSRGNNVDIEKVMITDEEEIRTTNPVATEQYGSVSTNLQAGNAQAATADVN

SEQ ID NO: 4184 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQSSDNNNSEFSWTGATKYHLNGRDSLVNPGPAMASHKDDDEKFFPQSGVLIFGKQNGRKGNVAIEEVMITDEEEIRTTNPVATEQYGSVSTNLQAGNAQAATADVN

SEQ ID NO: 4185 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSTTPADNNNSDFSWTGATKYHLNGRDSLVNPGPAMASHKDDDEKFFPQSGVLIFGKEDAAKTNAAVDQVMITDEEEIRTTNPVATEQYGSVSTNLQAGNAQAATADVN

SEQ ID NO: 4186 - protein, 334 aa, Artificial Sequence; identical to SEQ ID NO: 1698
  Synthetic

SEQ ID NO: 4187 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATAGRNTTSALGFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4188 - protein, 334 aa, Artificial Sequence; identical to SEQ ID NO: 506
  Synthetic

SEQ ID NO: 4189 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4190 - protein, 334 aa, Artificial Sequence; identical to SEQ ID NO: 3269
  Synthetic

SEQ ID NO: 4191 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQETKTRAAYAAVN

SEQ ID NO: 4192 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESATRGNVDIERVMITDEEEIRTTNPVATEQYGSVSTNLQAGNAQAATADVN

SEQ ID NO: 4193 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGNQTISKLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4194 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGSATQSRLQFSQAGASDIRDQSRNWLPGPCYRQQRVSKTSADNNNSEYSWTGATKYHLNGRDSLVNPGPAMASHKDDNEKFFPQSGVLIFGKEGSGKSDVAYDEVMITDEEEIRTTNPVATEQYGSVSTNLQAGNAQAATADVN

SEQ ID NO: 4195 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTAGPKTQSPLRFSQAGASDIRDQSRNWLPGPCYRQQRVSKTSADNNNSEYSWTGATTYHLNGRDSLVNPGPAMASHKDDEEKFFPQSGVLIFGKQGSAKSDVAIDEVMITDEEEIRTTNPVATEQYGSVSTNLQAGNAQAATADVN

SEQ ID NO: 4196 - protein, 334 aa, Artificial Sequence; identical to SEQ ID NO: 1204
  Synthetic

SEQ ID NO: 4197 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGNAGAAVKGVQ

SEQ ID NO: 4198 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKEKFFPQSGVLIFGKQSADGSDVDIDRVMITDEEEIRTTNPVATEQYGSVSTNLQAGNAQAATADVN

SEQ ID NO: 4199 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSEKTNVDIEKVMITDEEEIRTTNPVATEQYGSVSTNLQAGNAQAATADVN

SEQ ID NO: 4200 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDARGTAASDGVA

SEQ ID NO: 4201 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKQSSDNNNSEFSWTGATKYHLNGRDSLVNPGPAMASHEDDNDKFFPQSGVLIFGKQGSRKGNVDIEEVMITDEEEIRTTNPVATEQYGSVSTNLQAGNAQAATADVN

SEQ ID NO: 4202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 4203 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGAGRNDIAIGQVMITDEEEIRTTNPVATEQYGSVSTNLQAGNAQAATADVN

SEQ ID NO: 4204 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDGKFFPQSGVLIFGKEDSGGTNVEIGRVMITDEEEIRTTNPVATEQYGSVSTNLQAGNAQAATADVN

SEQ ID NO: 4205 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 4206 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRTGHTTISKLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4207 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGITTLSGLGFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 4208 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQNSARSDIDIEGVMITDEEEIRTTNPVATEQYGSVSTNLQAGNAQAATADVN

SEQ ID NO: 4209 - protein, 334 aa, Artificial Sequence; identical to SEQ ID NO: 2624
  Synthetic

SEQ ID NO: 4210 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQGTRDGAAVNDVT

SEQ ID NO: 4211 - protein, 334 aa, Artificial Sequence; identical to SEQ ID NO: 800
  Synthetic

SEQ ID NO: 4212 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGNTTTSPLLFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4213 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGTLTHSELSFSQAGASDIRDQSRNWLPGPCYRQQRVSKQSNENNNSDFSWTGATKYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 4214 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTQPTENNNSDFSWTGATKYHLNGRDSLVNPGPAMASHGDDNDKFFPQSGVLIFGKQGSEKTNVDIEKVMITDEEEIRTTNPVATEQYGSVSTNLQRGNRQAATADVN

SEQ ID NO: 4215 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTATGTDTHSGLLFSQAGASDIRDQSRNWLPGPCYRQQRVSKKSDQNNNSDFSWTGATKYHLNGRDSLVNPGPAMASHEDDNDRFFPQSGVLIFGKQGSEKTNVDIEKVMITDEEEIRTTNPVATEQYGSVSTNLQAGNAQAATADVN

SEQ ID NO: 4216 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSRLQFSQAGASDIRDQSRNWLPGPCYRQQRVSKKYTDNNNSNFSWTGATTYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 4217 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGRFFPQSGVLIFGKEGTEKSNVAIERVMITDEEEIRTTNPVATEQYGSVSTNLQAGNAQAATADVN

SEQ ID NO: 4218 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKESGGESNVDVEHVMITDEEEIRTTNPVATEQYGSVSTNLQAGNAQAATADVN

SEQ ID NO: 4219 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPAGNNNSEFSWTGATKYHLNGRDSLVNPGPAMASHRDDEDKFFPQSGVLIFGKEGANGANIEIGDVMITDEEEIRTTNPVATEQYGSVSTNLQAGNAQAATADVN

SEQ ID NO: 4220 - protein, 334 aa, Artificial Sequence; identical to SEQ ID NO: 219
  Synthetic

SEQ ID NO: 4221 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4222 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNSSGRITTSNLRFSQAGASDIRDQSRNWLPGPCYRQQRVSKTHGDNNNSEFSWTGATTYHLNGRDSLVNPGPAMASHKDDDDRFFPQSGVLIFGKQDTAGTDVAIDGVMITDEEEIRTTNPVATEQYGSVSTNLQAGNAQAATADVN

SEQ ID NO: 4223 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATHSQLRFSQAGASDIRDQSRNWLPGPCYRQQRVSKTSADNNNSEYSWTGATKYHLNGRDSLVNPGPAMASHKDDEGRFFPQSGVLIFGKQGATANNTEFEHVMITDEEEIRTTNPVATEQYGSVSTNLQAGNAQAATADVN

SEQ ID NO: 4224 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGAGANDVAYENVMITDEEEIRTTNPVATEQYGSVSTNLQRGNRQAATADVN

SEQ ID NO: 4225 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSTTPTGNNNSDFSWTGATKYHLNGRDSLVNPGPAMASHKDDDDRFFPQSGVLIFGKQSASKNNIAIEEVMITDEEEIRTTNPVATEQYGSVSTNLQAGNAQAATADVN

SEQ ID NO: 4226 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESAGANNVDIEEVMITDEEEIRTTNPVATEQYGSVSTNLQAGNAQAATADVN

SEQ ID NO: 4227 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4228 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGRFFPQSGVLIFGKQSAKAANAAIDEVMITDEEEIRTTNPVATEQYGSVSTNLQAGNAQAATADVN

SEQ ID NO: 4229 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRTQAAYGTVN

SEQ ID NO: 4230 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEGKFFPQSGVLIFGKQGSAGSNIAFDGVMITDEEEIRTTNPVATEQYGSVSTNLQAGNAQAATADVN

SEQ ID NO: 4231 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQASRTGAAFQGVH

SEQ ID NO: 4232 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKQSDRNNNSNFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 4233 - protein, 334 aa, Artificial Sequence; identical to SEQ ID NO: 1477
  Synthetic

SEQ ID NO: 4234 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSASTTAAVTEVK

SEQ ID NO: 4235 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGNHTISPLRFSQAGASDIRDQSRNWLPGPCYRQQRVSKTPNGNNNSDFSWTGATKYHLNGRDSLVNPGPAMASHKDDEDRFFPQSGVLIFGKESARENNAEIDEVMITDEEEIRTTNPVATEQYGSVSTNLQAGNAQAATADVN

SEQ ID NO: 4236 - protein, 334 aa, Artificial Sequence; identical to SEQ ID NO: 1380
  Synthetic

SEQ ID NO: 4237 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYTDNNNSNFSWTGATTYHLNGRDSLVNPGPAMASHKDDDDRFFPQSGVLIFGKEGTEKSNVAIERVMITDEEEIRTTNPVATEQYGSVSTNLQAGNAQAATADVN

SEQ ID NO: 4238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRTPAAIDGVA

SEQ ID NO: 4239 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGPTGIITPSDLRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4240 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKVSADNNNSEFSWTGATKYHLNGRDSLVNPGPAMASHKDDEEKFFPQSGVLIFGKQSANKTDADIDNVMITDEEEIRTTNPVATEQYGSVSTNLQAGNAQAATADVN

SEQ ID NO: 4241 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDTAATNVEFEGVMITDEEEIRTTNPVATEQYGSVSTNLQAGNAQAATADVN

SEQ ID NO: 4242 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGSTTMSTLRFSQAGASDIRDQSRNWLPGPCYRQQRVSTQSTGNNNSDFSWTGATKYHLNGRDSLVNPGPAMASHKDDDDRFFPQSGVLIFGKESSSGNDIEIDQVMITDEEEIRTTNPVATEQYGSVSTNLQAGNAQAATADVN

SEQ ID NO: 4243 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNNTISSLGFSQAGASDIRDQSRNWLPGPCYRQQRVSKKDSRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4244 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 4245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTHSSLVFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 4246 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQSGIETQSRLRFSQAGASDIRDQSRNWLPGPCYRQQRVSKTPAENNNSNFSWTGATTYHLNGRDSLVNPGPAMASHEDDNDRFFPQSGVLIFGKQNAGRDDVAIEEVMITDEEEIRTTNPVATEQYGSVSTNLQAGNAQAATADVN

SEQ ID NO: 4247 - protein, 334 aa, Artificial Sequence; identical to SEQ ID NO: 357
  Synthetic

SEQ ID NO: 4248 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQNSGKGNVAIDRVMITDEEEIRTTNPVATEQYGSVSTNLQAGNAQAATADVN

SEQ ID NO: 4249 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHGDDNDRFFPQSGVLIFGKESSGGDNIDVDEVMITDEEEIRTTNPVATEQYGSVSTNLQAGNAQAATADVN

SEQ ID NO: 4250 - protein, 334 aa, Artificial Sequence; identical to SEQ ID NO: 385
  Synthetic

SEQ ID NO: 4251 - protein, 334 aa, Artificial Sequence; identical to SEQ ID NO: 1000
  Synthetic

SEQ ID NO: 4252 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTTPADNNNSDFSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 4253 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKESAGTSDVDFDRVMITDEEEIRTTNPVATEQYGSVSTNLQAGNAQAATADVN

SEQ ID NO: 4254 - protein, 334 aa, Artificial Sequence; identical to SEQ ID NO: 202
  Synthetic

SEQ ID NO: 4255 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGGDKSDVDVEHVMITDEEEIRTTNPVATEQYGSVSTNLQAGNAQAATADVN

SEQ ID NO: 4256 - protein, 334 aa, Artificial Sequence; identical to SEQ ID NO: 641
  Synthetic

SEQ ID NO: 4257 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGAGANDVAYENVMITDEEEIRTTNPVATEQYGSVSTNLQAGNAQAATADVN

SEQ ID NO: 4258 - protein, 334 aa, Artificial Sequence; identical to SEQ ID NO: 563
  Synthetic

SEQ ID NO: 4259 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGARKSNVEVGEVMITDEEEIRTTNPVATEQYGSVSTNLQAGNAQAATADVN

SEQ ID NO: 4260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDGKKANVEVGQVMITDEEEIRTTNPVATEQYGSVSTNLQAGNAQAATADVN

SEQ ID NO: 4261 - protein, 334 aa, Artificial Sequence
  Synthetic
RSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHRDDADKFFPQSGVLIFGKENGKTTDVAFDQVMITDEEEIRTTNPVATEQYGSVSTNLQAGNAQAATADVN

SEQ ID NO: 4262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASSGLETMSTLRFSQAGASDIRDQSRNWLPGPCYRQQRVSKTDGENNNSDFSWTGATKYHLNGRDSLVNPGPAMASHRDDNDKFFPQSGVLIFGKEDAGGSDADVEQVMITDEEEIRTTNPVATEQYGSVSTNLQAGNAQAATADVN

SEQ ID NO: 4263 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4264 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGTPTHSTLKFSQAGASDIRDQSRNWLPGPCYRQQRVSTQPNHNNNSDFSWTGATKYHLNGRDSLVNPGPAMASHKDDEEKFFPQSGVLIFGKENSGKANVDIEQVMITDEEEIRTTNPVATEQYGSVSTNLQAGNAQAATADVN

SEQ ID NO: 4265 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGLETKSRLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4267 - protein, 334 aa, Artificial Sequence; identical to SEQ ID NO: 829
  Synthetic

SEQ ID NO: 4268 - protein, 334 aa, Artificial Sequence; identical to SEQ ID NO: 3712
  Synthetic

SEQ ID NO: 4269 - protein, 334 aa, Artificial Sequence; identical to SEQ ID NO: 718
  Synthetic

SEQ ID NO: 4270 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGHPTPSTLEFSQAGASDIRDQSRNWLPGPCYRQQRVSKTSADNNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4271 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGGAATKDVQ

SEQ ID NO: 4272 - protein, 334 aa, Artificial Sequence; identical to SEQ ID NO: 400
  Synthetic

SEQ ID NO: 4273 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQGRNDPAAFNNVD

SEQ ID NO: 4274 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGRETLSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4275 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 4276 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSRRNDVDIDRVMITDEEEIRTTNPVATEQYGSVSTNLQAGNAQAATADVN

SEQ ID NO: 4277 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRNAAANSVVD

SEQ ID NO: 4278 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGITTNSTLGFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4279 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKQPGDNNNSDFSWTGATTYHLNGRDSLVNPGPAMASHKDDDGKFFPQSGVLIFGKQGAEATDVAFDIVMITDEEEIRTTNPVATEQYGSVSTNLQAGNAQAATADVN

SEQ ID NO: 4280 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGNVTQSTLQFSQAGASDIRDQSRNWLPGPCYRQQRVSKTPDHNNNSDFSWTGATKYHLNGRDSLVNPGPAMASHKDDEGRFFPQSGVLIFGKQDTGASNVAIDRVMITDEEEIRTTNPVATEQYGSVSTNLQAGNAQAATADVN

SEQ ID NO: 4281 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKQDSTTANVDIDKVMITDEEEIRTTNPVATEQYGSVSTNLQAGNAQAATADVN

SEQ ID NO: 4282 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKEDTTGANADIGQVMITDEEEIRTTNPVATEQYGSVSTNLQAGNAQAATADVN

SEQ ID NO: 4283 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGHKTNSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4284 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSSDNNNSEFSWTGATKYHLNGRDSLVNPGPAMASHEDDADKFFPQSGVLIFGKEGATEGDVAIEKVMITDEEEIRTTNPVATEQYGSVSTNLQAGNAQAATADVN

SEQ ID NO: 4285 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKENAAEGNIDIDRVMITDEEEIRTTNPVATEQYGSVSTNLQAGNAQAATADVN

SEQ ID NO: 4286 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSAEGGNVDIDGVMITDEEEIRTTNPVATEQYGSVSTNLQAGNAQAATADVN

SEQ ID NO: 4287 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATISRLRFSQAGASDIRDQSRNWLPGPCYRQQRVSKTYNDNNNSEFSWTGATKYHLNGRDSLVNPGPAMASHKDDEEKFFPQSGVLIFGKQGSEKTNVDIEKVMITDEEEIRTTNPVATEQYGSVSTNLQGPKGRAADQNVN

SEQ ID NO: 4288 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGNTTLSRLLFSQAGASDIRDQSRNWLPGPCYRQQRVSKVSADNNNSEFSWTGATKYHLNGRDSLVNPGPAMASHKDDNEKFFPQSGVLIFGKQSASETDVDIDSVMITDEEEIRTTNPVATEQYGSVSTNLQAGNAQAATADVN

SEQ ID NO: 4289 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSDLKFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQRGNRQAATADVN

SEQ ID NO: 4290 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESSAKSNVAIDKVMITDEEEIRTTNPVATEQYGSVSTNLQAGNAQAATADVN

SEQ ID NO: 4291 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKQSGREGDAEIEDVMITDEEEIRTTNPVATEQYGSVSTNLQAGNAQAATADVN

SEQ ID NO: 4292 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4293 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKTAGRNNNSDFSWTGATTYHLNGRDSLVNPGPAMASHKDDEGRFFPQSGVLIFGKEGAGKSDIAIDGVMITDEEEIRTTNPVATEQYGSVSTNLQAGNAQAATADVN

SEQ ID NO: 4294 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQDAGGSNVEFGGVMITDEEEIRTTNPVATEQYGSVSTNLQAGNAQAATADVN

SEQ ID NO: 4295 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSTTDNGNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 4296 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4297 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGRFFPQSGVLIFGKQGSEKTNVDIEKVMITDEEEIRTTNPVATEQYGSVSTNLQAGNAQAATADVN

SEQ ID NO: 4298 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKQPNDNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4299 - protein, 334 aa, Artificial Sequence; identical to SEQ ID NO: 1265
  Synthetic

SEQ ID NO: 4300 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKEGSKKGNVEIDQVMITDEEEIRTTNPVATEQYGSVSTNLQAGNAQAATADVN

SEQ ID NO: 4301 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4302 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSEFSWTGATKYHLNGRDSLVNPGPAMASHKDDEEKFFPQSGVLIFGKQGSEKTNVDIEKVMITDEEEIRTTNPVATEQYGSVSTNLQDRRTTAAFTDVP

SEQ ID NO: 4303 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQPGDNNNSNFSWTGATKYHLNGRDSLVNPGPAMASHKDDDDRFFPQSGVLIFGKQGGAKANVDVEHVMITDEEEIRTTNPVATEQYGSVSTNLQAGNAQAATADVN

SEQ ID NO: 4304 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 4305 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDEGKFFPQSGVLIFGKQGSEKTNVDIEKVMITDEEEIRTTNPVATEQYGSVSTNLQAGNAQAATADVN

SEQ ID NO: 4306 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGHATTSTLLFSQAGASDIRDQSRNWLPGPCYRQQRVSKQSADNNNSDFSWTGATKYHLNGRDSLVNPGPAMASHKDDADKFFPQSGVLIFGKEGAAKSDVAVGGVMITDEEEIRTTNPVATEQYGSVSTNLQAGNAQAATADVN

SEQ ID NO: 4307 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSDFSWTGATTYHLNGRDSLVNPGPAMASHKDDDERFFPQSGVLIFGKQNAAANNADYESVMITDEEEIRTTNPVATEQYGSVSTNLQAGNAQAATADVN

SEQ ID NO: 4308 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKSGTTTLSGLLFSQAGASDIRDQSRNWLPGPCYRQQRVSTTAGDNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4309 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQATRNNNSEFSWTGATKYHLNGRDSLVNPGPAMASHEDDDGKFFPQSGVLIFGKQGSEKTNVDIEKVMITDEEEIRTTNPVATEQYGSVSTNLQAGNAQAATADVN

SEQ ID NO: 4310 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGSHTQSALRFSQAGASDIRDQSRNWLPGPCYRQQRVSKTPAENNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4311 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGTGKANIDIDKVMITDEEEIRTTNPVATEQYGSVSTNLQAGNAQAATADVN

SEQ ID NO: 4312 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 4313 - protein, 334 aa, Artificial Sequence; identical to SEQ ID NO: 371
  Synthetic

SEQ ID NO: 4314 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGINTLSRLVFSQAGASDIRDQSRNWLPGPCYRQQRVSKTSADNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4315 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKTSADNNNSEYSWTGATKYHLNGRDSLVNPGPAMASHKDDEEKFFPQSGVLIFGKQGTGGSDAAIDGVMITDEEEIRTTNPVATEQYGSVSTNLQAGNAQAATADVN

SEQ ID NO: 4316 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 4317 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRTGNMTTSPLGFSQAGASDIRDQSRNWLPGPCYRQQRVSKTPDGNNNSNFSWTGATKYHLNGRDSLVNPGPAMASHKDDEDRFFPQSGVLIFGKQNATKANADFGDVMITDEEEIRTTNPVATEQYGSVSTNLQAGNAQAATADVN

SEQ ID NO: 4318 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 4319 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGRATQSRLVFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4320 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTQSTGNNNSDFSWTGATKYHLNGRDSLVNPGPAMASHKDDDDRFFPQSGVLIFGKEGSAASNVDIGGVMITDEEEIRTTNPVATEQYGSVSTNLQAGNAQAATADVN

SEQ ID NO: 4321 - protein, 334 aa, Artificial Sequence; identical to SEQ ID NO: 460
  Synthetic

SEQ ID NO: 4322 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGSKTLSALLFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 4323 - protein, 334 aa, Artificial Sequence; identical to SEQ ID NO: 326
  Synthetic

SEQ ID NO: 4324 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGSGNAAFQTVN

SEQ ID NO: 4325 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKKHSQAADAMVN

SEQ ID NO: 4326 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGRAGAAVSEVK

SEQ ID NO: 4327 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGADGNNVAFGEVMITDEEEIRTTNPVATEQYGSVSTNLQAGNAQAATADVN

SEQ ID NO: 4328 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHEDDEGKFFPQSGVLIFGKQGARGADAEIESVMITDEEEIRTTNPVATEQYGSVSTNLQAGNAQAATADVN

SEQ ID NO: 4329 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKENASGTNVDIGNVMITDEEEIRTTNPVATEQYGSVSTNLQAGNAQAATADVN

SEQ ID NO: 4330 - protein, 334 aa, Artificial Sequence; identical to SEQ ID NO: 548
  Synthetic

SEQ ID NO: 4331 - protein, 334 aa, Artificial Sequence; identical to SEQ ID NO: 325
  Synthetic

SEQ ID NO: 4332 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDNGRFFPQSGVLIFGKQDADGNDVAIDQVMITDEEEIRTTNPVATEQYGSVSTNLQAGNAQAATADVN

SEQ ID NO: 4333 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDNENNNSDFSWTGATTYHLNGRDSLVNPGPAMASHKDDNEKFFPQSGVLIFGKQNATGTNVDVGSVMITDEEEIRTTNPVATEQYGSVSTNLQAGNAQAATADVN

SEQ ID NO: 4334 - protein, 334 aa, Artificial Sequence; identical to SEQ ID NO: 584
  Synthetic

SEQ ID NO: 4335 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGRVTISGLRFSQAGASDIRDQSRNWLPGPCYRQQRVSKTDGENNNSDFSWTGATKYHLNGRDSLVNPGPAMASHKDDEERFFPQSGVLIFGKENSGKSDVAIDKVMITDEEEIRTTNPVATEQYGSVSTNLQAGNAQAATADVN

SEQ ID NO: 4336 - protein, 334 aa, Artificial Sequence; identical to SEQ ID NO: 3706
  Synthetic

SEQ ID NO: 4337 - protein, 334 aa, Artificial Sequence; identical to SEQ ID NO: 1445
  Synthetic

SEQ ID NO: 4338 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENTNKDNVDIERVMITDEEEIRTTNPVATEQYGSVSTNLQAGNAQAATADVN

SEQ ID NO: 4339 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSRKGNVDIEEVMITDEEEIRTTNPVATEQYGSVSTNLQAGNAQAATADVN

SEQ ID NO: 4340 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDEDKFFPQSGVLIFGKQGSEKTNVDIEKVMITDEEEIRTTNPVATEQYGSVSTNLQRPKAPAADTTVN

SEQ ID NO: 4341 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESSTTGNVAIEGVMITDEEEIRTTNPVATEQYGSVSTNLQAGNAQAATADVN

SEQ ID NO: 4342 - protein, 334 aa, Artificial Sequence; identical to SEQ ID NO: 362
  Synthetic

SEQ ID NO: 4343 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEEKFFPQSGVLIFGKEGGGKTNVDFDKVMITDEEEIRTTNPVATEQYGSVSTNLQAGNAQAATADVN

SEQ ID NO: 4344 - protein, 334 aa, Artificial Sequence
  Synthetic
ESGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTKSSLSFSQAGASDIRDQSRNWLPGPCYRQQRVSKQPNQNNNSNFSWTGATKYHLNGRDSLVNPGPAMASHRDDEDKFFPQSGVLIFGKESSGANNVEVDGVMITDEEEIRTTNPVATEQYGSVSTNLQAGNAQAATADVN

SEQ ID NO: 4345 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTAAGNVDVDGVMITDEEEIRTTNPVATEQYGSVSTNLQAGNAQAATADVN

SEQ ID NO: 4346 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDDDRFFPQSGVLIFGKEGAGKTNIAVDRVMITDEEEIRTTNPVATEQYGSVSTNLQAGNAQAATADVN

SEQ ID NO: 4347 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGGRKGNADIDEVMITDEEEIRTTNPVATEQYGSVSTNLQAGNAQAATADVN

SEQ ID NO: 4348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTTTPSKLIFSQAGASDIRDQSRNWLPGPCYRQQRVSKQSDRNNNSEFSWTGATKYHLNGRDSLVNPGPAMASHKDDDDRFFPQSGVLIFGKEGSNKTNIDIDRVMITDEEEIRTTNPVATEQYGSVSTNLQAGNAQAATADVN

SEQ ID NO: 4349 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4350 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 4351 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQNSAETNVEIDGVMITDEEEIRTTNPVATEQYGSVSTNLQAGNAQAATADVN

SEQ ID NO: 4352 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSTTPTGNNNSDFSWTGATKYHLNGRDSLVNPGPAMASHKDDDDRFFPQSGVLIFGKQSASKNNIAIEEVMITDEEEIRTTNPVATEQYGSVSTNLQAGNAQAATADVN

SEQ ID NO: 4353 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNSAAAFSGVD

SEQ ID NO: 4354 - protein, 334 aa, Artificial Sequence; identical to SEQ ID NO: 2829
  Synthetic

SEQ ID NO: 4355 - protein, 334 aa, Artificial Sequence; identical to SEQ ID NO: 155
  Synthetic

SEQ ID NO: 4356 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4357 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKESGRANDADIESVMITDEEEIRTTNPVATEQYGSVSTNLQAGNAQAATADVN

SEQ ID NO: 4358 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTTGNITISKLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4359 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQSSTRGNAAVDEVMITDEEEIRTTNPVATEQYGSVSTNLQAGNAQAATADVN

SEQ ID NO: 4360 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 4361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDAAKSDAAYEEVMITDEEEIRTTNPVATEQYGSVSTNLQAGNAQAATADVN

SEQ ID NO: 4362 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSGLQFSQAGASDIRDQSRNWLPGPCYRQQRVSKTSADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4363 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKQSGDNNNSEFSWTGATKYHLNGRDSLVNPGPAMASHKDDEEKFFPQSGVLIFGKENATGGDAEIDQVMITDEEEIRTTNPVATEQYGSVSTNLQAGNAQAATADVN

SEQ ID NO: 4364 - protein, 334 aa, Artificial Sequence; identical to SEQ ID NO: 2664
  Synthetic

SEQ ID NO: 4365 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDNDKFFPQSGVLIFGKEDSRKSNADIEGVMITDEEEIRTTNPVATEQYGSVSTNLQAGNAQAATADVN

SEQ ID NO: 4366 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDDNNNSDFSWPGATKYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 4367 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNATGRDTMSTLKFSQAGASDIRDQSRNWLPGPCYRQQRVSKTHGDNNNSNFSWTGATTYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 4368 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSEYSWTGATKYHLNGRDSLVNPGPAMASHKDDEEKFFPQSGVLIFGKQGGTGDDVAIDKVMITDEEEIRTTNPVATEQYGSVSTNLQAGNAQAATADVN

SEQ ID NO: 4369 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 4370 - protein, 334 aa, Artificial Sequence; identical to SEQ ID NO: 1190
  Synthetic

SEQ ID NO: 4371 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 4372 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTTGPMTMSALRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANKDPAAFKEVN

SEQ ID NO: 4373 - protein, 334 aa, Artificial Sequence; identical to SEQ ID NO: 925
  Synthetic

SEQ ID NO: 4374 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWPGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 4375 - protein, 334 aa, Artificial Sequence; identical to SEQ ID NO: 3717
  Synthetic

SEQ ID NO: 4376 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNGEEGNVDIGRVMITDEEEIRTTNPVATEQYGSVSTNLQAGNAQAATADVN

SEQ ID NO: 4377 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGTKKTNAEIEDVMITDEEEIRTTNPVATEQYGSVSTNLQAGNAQAATADVN

SEQ ID NO: 4378 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHRDDDEKFFPQSGVLIFGKQSAKAANAAIDEVMITDEEEIRTTNPVATEQYGSVSTNLQAGNAQAATADVN

SEQ ID NO: 4379 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAVNVQAATADVN

SEQ ID NO: 4380 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGHNTLSGLRFSQAGASDIRDQSRNWLPGPCYRQQRVSTTPGGNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 4381 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGHVTLSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4382 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDGGSMTLSRLRFSQAGASDIRDQSRNWLPGPCYRQQRVSKQSSDNNNSEFSWTGATKYHLNGRDSLVNPGPAMASHEDDADKFFPQSGVLIFGKEDSRGGNVDIGGVMITDEEEIRTTNPVATEQYGSVSTNLQAGNAQAATADVN

SEQ ID NO: 4383 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRSQAAAEDVK

SEQ ID NO: 4384 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWPGATKYHLNGRDSLVNPGPAMASHKDDEEKFFPQSGVLIFGKQSSTRGNAAVDEVMITDEEEIRTTNPVATEQYGSVSTNLQAGNAQAATADVN

SEQ ID NO: 4385 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNATAGNVDFDKVMITDEEEIRTTNPVATEQYGSVSTNLQAGNAQAATADVN

SEQ ID NO: 4386 - protein, 334 aa, Artificial Sequence; identical to SEQ ID NO: 2463
  Synthetic

SEQ ID NO: 4387 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSKLKFSQAGASDIRDQSRNWLPGPCYRQQRVSKQHNQNNNSEFSWTGATTYHLNGRDSLVNPGPAMASHKDDDEKFFPQSGVLIFGKESTKRANAEIGEVMITDEEEIRTTNPVATEQYGSVSTNLQAGNAQAATADVN

SEQ ID NO: 4388 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTTADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4389 - protein, 334 aa, Artificial Sequence; identical to SEQ ID NO: 947
  Synthetic

SEQ ID NO: 4390 - protein, 334 aa, Artificial Sequence; identical to SEQ ID NO: 1473
  Synthetic

SEQ ID NO: 4391 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKSGAANADVQ

SEQ ID NO: 4392 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDGKFFPQSGVLIFGKQDTTRGNADVDQVMITDEEEIRTTNPVATEQYGSVSTNLQAGNAQAATADVN

SEQ ID NO: 4393 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAVNAQAATADVN

SEQ ID NO: 4394 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAETGTATTSRLKFSQAGASDIRDQSRNWLPGPCYRQQRVSKKASDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 4395 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTRNNNSNFSWTGATTYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 4396 - protein, 334 aa, Artificial Sequence; identical to SEQ ID NO: 681
  Synthetic

SEQ ID NO: 4397 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 4398 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSKRGGAAFTTVE

SEQ ID NO: 4399 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHEDDNDKFFPQSGVLIFGKESAGANNVDIGGVMITDEEEIRTTNPVATEQYGSVSTNLQAGNAQAATADVN

SEQ ID NO: 4401 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNSGIKTHSSLGFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4402 - protein, 334 aa, Artificial Sequence; identical to SEQ ID NO: 1303
  Synthetic

SEQ ID NO: 4403 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSTQPTENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4404 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKQPSRNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4405 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTDQSRAAFTEVD

SEQ ID NO: 4406 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSKTHNHNNNSDFSWTGATKYHLNGRDSLVNPGPAMASHKDDEDKFFPQSGVLIFGKQSAKAANAAIDEVMITDEEEIRTTNPVATEQYGSVSTNLQAGNAQAATADVN

SEQ ID NO: 4407 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 4408 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKQGGGATDVEIGNVMITDEEEIRTTNPVATEQYGSVSTNLQAGNAQAATADVN

SEQ ID NO: 4409 - protein, 334 aa, Artificial Sequence; identical to SEQ ID NO: 652
  Synthetic

SEQ ID NO: 4410 - protein, 334 aa, Artificial Sequence; identical to SEQ ID NO: 3112
  Synthetic

SEQ ID NO: 4411 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGLETKSRLRFSQAGASDIRDQSRNWLPGPCYRQQRVSTQSGRNNNSDFSWPGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4412 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGSNHAAAKEVH

SEQ ID NO: 4413 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSGKDNVEVGQVMITDEEEIRTTNPVATEQYGSVSTNLQAGNAQAATADVN

SEQ ID NO: 4414 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSNGNNNSEFSWTGATKYHLNGRDSLVNPGPAMASHRDDEDRFFPQSGVLIFGKQSGSKNDIAIEDVMITDEEEIRTTNPVATEQYGSVSTNLQAGNAQAATADVN

SEQ ID NO: 4415 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSETTSRLRFSQAGASDIRDQSRNWLPGPCYRQQRVSKVSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4416 - protein, 334 aa, Artificial Sequence; identical to SEQ ID NO: 157
  Synthetic

SEQ ID NO: 4417 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDSRKSNADIEGVMITDEEEIRTTNPVATEQYGSVSTNLQRGNRQAATADVN

SEQ ID NO: 4418 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESATKANADIDRVMITDEEEIRTTNPVATEQYGSVSTNLQAGNAQAATADVN

SEQ ID NO: 4419 - protein, 334 aa, Artificial Sequence; identical to SEQ ID NO: 438
  Synthetic

SEQ ID NO: 4420 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGARGHAAVRDVA

SEQ ID NO: 4421 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQSSATGDTEIDGVMITDEEEIRTTNPVATEQYGSVSTNLQAGNAQAATADVN

SEQ ID NO: 4422 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHKDDDERFFPQSGVLIFGKEGSGKNDVEVDRVMITDEEEIRTTNPVATEQYGSVSTNLQAGNAQAATADVN

SEQ ID NO: 4423 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPKANAAAQIVE

SEQ ID NO: 4424 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATRYHLNGRDSLVNPGPAMASHKDDEEKFFPQSGVLIFGKQGSEKTNVDIEKVMITDEEEIRTTNPVATEQYGSVSTNLQERSGAAAIEDVD

SEQ ID NO: 4425 - protein, 334 aa, Artificial Sequence; identical to SEQ ID NO: 3522
  Synthetic

SEQ ID NO: 4426 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGPITMSRLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4427 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 4428 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKESGSGSDVDFDHVMITDEEEIRTTNPVATEQYGSVSTNLQAGNAQAATADVN

SEQ ID NO: 4429 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPNSDAANDKVD

SEQ ID NO: 4430 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSDRAPAATSTVK

SEQ ID NO: 4431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHRDDAGRFFPQSGVLIFGKQNAGASDADFDQVMITDEEEIRTTNPVATEQYGSVSTNLQAGNAQAATADVN

SEQ ID NO: 4432 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDTGKFFPQSGVLIFGKESANKTNIDIEHVMITDEEEIRTTNPVATEQYGSVSTNLQAGNAQAATADVN

SEQ ID NO: 4433 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGLTTMSRLGFSQAGASDIRDQSRNWLPGPCYRQQRVSKVSADNNNSEFSWTGATKYHLNGRDSLVNPGPAMASHKDDEEKFFPQSGVLIFGKEDSKANNVAIDKVMITDEEEIRTTNPVATEQYGSVSTNLQAGNAQAATADVN

SEQ ID NO: 4434 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDEGRFFPQSGVLIFGKQGSRGNDVDVEEVMITDEEEIRTTNPVATEQYGSVSTNLQAGNAQAATADVN

SEQ ID NO: 4435 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANRDGAAVRVVH

SEQ ID NO: 4436 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHRDDNDKFFPQSGVLIFGKEGTARNNAAFDEVMITDEEEIRTTNPVATEQYGSVSTNLQAGNAQAATADVN

SEQ ID NO: 4437 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 4438 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTHGGITTMSQLRFSQAGASDIRDQSRNWLPGPCYRQQRVSTKDTDNNNSNFSWTGATKYHLNGRDSLVNPGPAMASHKDDEEKFFPQSGVLIFGKEGAGKANVEFERVMITDEEEIRTTNPVATEQYGSVSTNLQAGNAQAATADVN

SEQ ID NO: 4439 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQNGRTGDADVEQVMITDEEEIRTTNPVATEQYGSVSTNLQAGNAQAATADVN

SEQ ID NO: 4440 - protein, 334 aa, Artificial Sequence; identical to SEQ ID NO: 1288
  Synthetic

SEQ ID NO: 4441 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDEEKFFPQSGVLIFGKQSTEKDNVAVEQVMITDEEEIRTTNPVATEQYGSVSTNLQAGNAQAATADVN

SEQ ID NO: 4442 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGLQTLSDLRFSQAGASDIRDQSRNWLPGPCYRQQRVSTTSNENNNSDFSWTGATTYHLNGRDSLVNPGPAMASHRDDDERFFPQSGVLIFGKQGTGKNNIAFEDVMITDEEEIRTTNPVATEQYGSVSTNLQAGNAQAATADVN

SEQ ID NO: 4443 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDDRFFPQSGVLIFGKQGSEKTNVDIEKVMITDEEEIRTTNPVATEQYGSVSTNLQAHSDGAATTTVD

SEQ ID NO: 4444 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGPTTLSKLNFSQAGASDIRDQSRNWLPGPCYRQQRVSKTSTENNNSEFSWTGATTYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 4445 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKEDAAKTNAAVDQVMITDEEEIRTTNPVATEQYGSVSTNLQAGNAQAATADVN

SEQ ID NO: 4446 - protein, 334 aa, Artificial Sequence; identical to SEQ ID NO: 1333
  Synthetic

SEQ ID NO: 4447 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNTQAATADVN

SEQ ID NO: 4448 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGAGKTNIAYGNVMITDEEEIRTTNPVATEQYGSVSTNLQAGNAQAATADVN

SEQ ID NO: 4449 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGATGSNVEYGSVMITDEEEIRTTNPVATEQYGSVSTNLQAGNAQAATADVN

SEQ ID NO: 4450 - protein, 334 aa, Artificial Sequence; identical to SEQ ID NO: 2046
  Synthetic

SEQ ID NO: 4451 - protein, 334 aa, Artificial Sequence; identical to SEQ ID NO: 2238
  Synthetic

SEQ ID NO: 4452 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNRNADAAVDEVN

SEQ ID NO: 4453 - protein, 334 aa, Artificial Sequence; identical to SEQ ID NO: 609
  Synthetic

SEQ ID NO: 4454 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHRDDAGNFFPQSGVLIFGKQGTNETNIDIDGVMITDEEEIRTTNPVATEQYGSVSTNLQAGNAQAATADVN

SEQ ID NO: 4455 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4456 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTEKFFPQSGVLIFGKQGSEKTNVDIEKVMITDEEEIRTTNPVATEQYGSVSTNLQAGNAQAATADVN

SEQ ID NO: 4457 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSTKAGENNNSNFSWPGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4458 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGHHTPSGLKFSQAGASDIRDQSRNWLPGPCYRQQRVSKKHDHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4459 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSAGNVTKSGLRFSQAGASDIRDQSRNWLPGPCYRQQRVSKTHGDNNNSNFSWTGATTYHLNGRDSLVNPGPAMASHRDDNEKFFPQSGVLIFGKQSAGANNVEIESVMITDEEEIRTTNPVATEQYGSVSTNLQAGNAQAATADVN

SEQ ID NO: 4460 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKQNAGGNDIAIGEVMITDEEEIRTTNPVATEQYGSVSTNLQAGNAQAATADVN

SEQ ID NO: 4461 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKKPDQNNNSEFSWTGATKYHLNGRDSLVNPGPAMASHKDDEEKFFPQSGVLIFGKEGSTGSNVEYDRVMITDEEEIRTTNPVATEQYGSVSTNLQAGNAQAATADVN

SEQ ID NO: 4462 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPSATAATAGVA

SEQ ID NO: 4463 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGPQTNSGLGFSQAGASDIRDQSRNWLPGPCYRQQRVSKTHGDNNNSNFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 4464 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSKQSDQNNNSEFSWTGATKYHLNGRDSLVNPGPAMASHKDDDDKFFPQSGVLIFGKQDAEKNDVAIEEVMITDEEEIRTTNPVATEQYGSVSTNLQAGNAQAATADVN

SEQ ID NO: 4465 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSGGHPTTSALLFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4466 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKTSADNNNSNFSWTGATKYHLNGRDSLVNPGPAMASHRDDEDKFFPQSGVLIFGKQDAGANNAEVGEVMITDEEEIRTTNPVATEQYGSVSTNLQAGNAQAATADVN

SEQ ID NO: 4467 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQPGDNNNSNFSWTGATKYHLNGRDSLVNPGPAMASHKDDDDRFFPQSGVLIFGKQCGAKANVDVEHVMITDEEEIRTTNPVATEQYGSVSTNLQAGNAQAATADVN

SEQ ID NO: 4468 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATKYHLNGRDSLVNPGPAMASHKDDNDRFFPQSGVLIFGKQSAGGSDVAFDEVMITDEEEIRTTNPVATEQYGSVSTNLQAGNAQAATADVN

SEQ ID NO: 4469 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQGTRKNDVAIDEVMITDEEEIRTTNPVATEQYGSVSTNLQAGNAQAATADVN

SEQ ID NO: 4470 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHQDDEGRFFPQSGVLIFGKQGAGKNNAAIGQVMITDEEEIRTTNPVATEQYGSVSTNLQAGNAQAATADVN

SEQ ID NO: 4471 - protein, 334 aa, Artificial Sequence; identical to SEQ ID NO: 42
  Synthetic

SEQ ID NO: 4472 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTTPNENNNSDFSWTGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 4473 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQHGHNNNSDFSWTGATKYHLNGRDSLVNPGPAMASHKDDDDKFFPQSGVLIFGKQSGREGDAEIEDVMITDEEEIRTTNPVATEQYGSVSTNLQAGNAQAATADVN

SEQ ID NO: 4474 - protein, 334 aa, Artificial Sequence; identical to SEQ ID NO: 382
  Synthetic

SEQ ID NO: 4475 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGPETTSGLRFSQAGASDIRDQSRNWLPGPCYRQQRVSKKDSRNNNSDFSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 4476 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSGGRSNVGIDQVMITDEEEIRTTNPVATEQYGSVSTNLQAGNAQAATADVN

SEQ ID NO: 4477 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHNDDEGRFFPQSGVLIFGKQGAGKNNAAIGQVMITDEEEIRTTNPVATEQYGSVSTNLQAGNAQAATADVN

SEQ ID NO: 4478 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQHNQNNNSEFSWTGATTYHLNGRDSLVNPGPAMASHKDDDEKFFPQSGVLIFGKQGSNGTNVDVDGVMITDEEEIRTTNPVATEQYGSVSTNLQAGNAQAATADVN

SEQ ID NO: 4479 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSKTSADNNNSEYSWTGATKYHLNGRDSLVNPGPAMASHKDDEEKFFPQSGVLIFGKQNASENNAAIEDVMITDEEEIRTTNPVATEQYGSVSTNLQAGNAQAATADVN

SEQ ID NO: 4480 - protein, 334 aa, Artificial Sequence; identical to SEQ ID NO: 101
  Synthetic

SEQ ID NO: 4481 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQDAENNNSEFSWPGATKYHLNGRDSLVNPGPAMASHKGDEEKFFPQSGVLIFGKQGSEKTNVDIEKVMITDEEEIRTTNPVATEQYGSVSTNLQRGNRQAATADVN

SEQ ID NO: 4482 - protein, 334 aa, Artificial Sequence; identical to SEQ ID NO: 1163
  Synthetic

SEQ ID NO: 4483 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDTGKFFPQSGVLIFGKEGAGGSNVAVDGVMITDEEEIRTTNPVATEQYGSVSTNLQAGNAQAATADVN

SEQ ID NO: 4484 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGLTTPSDLKFSQAGASDIRDQSRNWLPGPCYRQQRVSKKYTDNNNSNFSWTGATTYHLNGRDSLVNPGPAMASHRDDEDKFFPQSGVLIFGKEGSEKTNVDIEKVMITDEEEIRTTNPVATEQYGSVSTNLQAGNAQAATADVN

SEQ ID NO: 4485 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTPSDLRFSQAGASDIRDQSRNWLPGPCYRQQRVSTQANHNNNSEFSWTGATKYHLNGRDSLVNPGPAMASHEDDAGRFFPQSGVLIFGKQDAAGTDVAFDGVMITDEEEIRTTNPVATEQYGSVSTNLQAGNAQAATADVN

SEQ ID NO: 4486 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDDRFFPQSGVLIFGKQGSAASDIDIDRVMITDEEEIRTTNPVATEQYGSVSTNLQAGNAQAATADVN

SEQ ID NO: 4487 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGTTGANVAYEDVMITDEEEIRTTNPVATEQYGSVSTNLQAGNAQAATADVN

SEQ ID NO: 4488 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGNTTLSRLLFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 4489 - protein, 334 aa, Artificial Sequence; identical to SEQ ID NO: 1202
  Synthetic

SEQ ID NO: 4490 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTYNHNNNSEFSWTGATKYHLNGRDSLVNPGPAMASHKDDDDRFFPQSGVLIFGKENAGKSDVEIEHVMITDEEEIRTTNPVATEQYGSVSTNLQAGNAQAATADVN

SEQ ID NO: 4491 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGLPTLSNLRFSQAGASDIRDQSRNWLPGPCYRQQRVSKTSADNNNSEYSWTGATKYHLNGRDSLVNPGPAMASHKDDEEKFFPQSGVLIFGKEGAGGTDTEIERVMITDEEEIRTTNPVATEQYGSVSTNLQAGNAQAATADVN

SEQ ID NO: 4492 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHGDDNDKFFPQSGVLIFGKEDAGKTNIDIGQVMITDEEEIRTTNPVATEQYGSVSTNLQAGNAQAATADVN

SEQ ID NO: 4493 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGIETQSRLLFSQAGASDIRDQSRNWLPGPCYRQQRVSKTSADNNNSNFSWTGATKYHLNGRDSLVNPGPAMASHRDDEDKFFPQSGVLIFGKEGSGKANVAIDRVMITDEEEIRTTNPVATEQYGSVSTNLQAGNAQAATADVN

SEQ ID NO: 4494 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4495 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRIQFSQAGASDIRDQSRNWLPGPCYRQQRVSKTSADNNNSEYSWTGATKYHLNGRDSLVNPGPAMASHKDDEEKFFPQSGVLIFGKQNGRKTDAEVEHVMITDEEEIRTTNPVATEQYGSVSTNLQAGNAQAATADVN

SEQ ID NO: 4496 - protein, 334 aa, Artificial Sequence; identical to SEQ ID NO: 909
  Synthetic

SEQ ID NO: 4497 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVN

SEQ ID NO: 4498 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRKGQAASAEVN

SEQ ID NO: 4499 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSEFSWPGATKYHLNGRDSLVNPGPAMASHKDDEEKFFPQSGVLIFGKESSGEGNVDVDSVMITDEEEIRTTNPVATEQYGSVSTNLQRGNRQAATADVN

SEQ ID NO: 4500 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTHSRLNFSQAGASDIRDQSRNWLPGPCYRQQRVSKTDGENNNSDFSWTGATKYHLNGRDSLVNPGPAMASHKDDEEKFFPQSGVLIFGKEGTDANDVDVGQVMITDEEEIRTTNPVATEQYGSVSTNLQAGNAQAATADVN

SEQ ID NO: 4501 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKANTRAAAQDVQ

SEQ ID NO: 4502 - protein, 334 aa, Artificial Sequence; identical to SEQ ID NO: 1419
  Synthetic

SEQ ID NO: 4503 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQHNQNNNSEFSWTGATTYHLNGRDSLVNPGPAMASHKDDDEKFFPQSGVLIFGKQDSGATDAEVDGVMITDEEEIRTTNPVATEQYGSVSTNLQAGNAQAATADVN

SEQ ID NO: 4504 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPGGIVTQSRLRFSQAGASDIRDQSRNWLPGPCYRQQRVSTQDTQNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 4505 - protein, 334 aa, Artificial Sequence; identical to SEQ ID NO: 86
  Synthetic

SEQ ID NO: 4506 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGINTHSRLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4507 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHNDDADKFFPQSGVLIFGKQGSEKTNVDIEKVMITDEEEIRTTNPVATEQYGSVSTNLQAGNAQAATADVN

SEQ ID NO: 4508 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDSRKSNADIEGVMITDEEEIRTTNPVATEQYGSVSTNLQRGNRQAATADVN

SEQ ID NO: 4509 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNTTQSRLHFSQAGASDIRDQSRNWLPGPCYRQQRVSKTSTENNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4510 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSELVFSQAGASDIRDQSRNWLPGPCYRQQRVSKTHGDNNNSNFSWTGATTYHLNGRDSLVNPGPAMASHKDDNDRFFPQSGVLIFGKEGAGANDVAVEHVMITDEEEIRTTNPVATEQYGSVSTNLQAGNAQAATADVN

SEQ ID NO: 4511 - protein, 334 aa, Artificial Sequence; identical to SEQ ID NO: 2857
  Synthetic

SEQ ID NO: 4512 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPSGINTPSRLLFSQAGASDIRDQSRNWLPGPCYRQQRVSKQPNDNNNSEFSWTGATTYHLNGRDSLVNPGPAMASHKDDNDRFFPQSGVLIFGKEGARKNDAEIGSVMITDEEEIRTTNPVATEQYGSVSTNLQAGNAQAATADVN

SEQ ID NO: 4513 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKSGTTTLSGLLFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 4514 - protein, 334 aa, Artificial Sequence; identical to SEQ ID NO: 78
  Synthetic

SEQ ID NO: 4515 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADKFFPQSGVLIFGKEGTEKSNVAIERVMITDEEEIRTTNPVATEQYGSVSTNLQAGNAQAATADVN

SEQ ID NO: 4516 - protein, 334 aa, Artificial Sequence; identical to SEQ ID NO: 2394
  Synthetic

SEQ ID NO: 4517 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRSAPAASGDVT

SEQ ID NO: 4518 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQSGEKNDVDIDGVMITDEEEIRTTNPVATEQYGSVSTNLQAGNAQAATADVN

SEQ ID NO: 4519 - protein, 334 aa, Artificial Sequence; identical to SEQ ID NO: 1594
  Synthetic

SEQ ID NO: 4520 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPNAPAADRGVP

SEQ ID NO: 4521 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 4522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDAGAANVEFGQVMITDEEEIRTTNPVATEQYGSVSTNLQAGNAQAATADVN

SEQ ID NO: 4523 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGPTTQSKLQFSQAGASDIRDQSRNWLPGPCYRQQRVSKTSNGNNNSEFSWTGATKYHLNGRDSLVNPGPAMASHRDDDDKFFPQSGVLIFGKEGAGKTNIAVDRVMITDEEEIRTTNPVATEQYGSVSTNLQAGNAQAATADVN

SEQ ID NO: 4524 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQQNPAAIRGVA

SEQ ID NO: 4525 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGNTTISALKFSQAGASDIRDQSRNWLPGPCYRQQRVSKKYTDNNNSNFSWTGATKYHLNGRDSLVNPGPAMASHRDDDEKFFPQSGVLIFGKQGSEKTNVDIEKVMITDEEEIRTTNPVATEQYGSVSTNLQETKSGAAYRDVT

SEQ ID NO: 4526 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSKQHNQNNNSEFSWTGATTYHLNGRDSLVNPGPAMASHKDDEEKFFPQSGVLIFGKQDSGATDAEVDGVMITDEEEIRTTNPVATEQYGSVSTNLQAGNAQAATADVN

SEQ ID NO: 4527 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAKGQAATHVVN

SEQ ID NO: 4528 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDGKFFPQSGVLIFGKQGSEKTNVDIEKVMITDEEEIRTTNPVATEQYGSVSTNLQGRRDPAADTIVP

SEQ ID NO: 4529 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4530 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDAGRTNIEYEKVMITDEEEIRTTNPVATEQYGSVSTNLQAGNAQAATADVN

SEQ ID NO: 4531 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGNTTTSPLLFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4532 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSTASNIAIEGVMITDEEEIRTTNPVATEQYGSVSTNLQAGNAQAATADVN

SEQ ID NO: 4533 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDAGRFFPQSGVLIFGKEGSGATDVEYGQVMITDEEEIRTTNPVATEQYGSVSTNLQAGNAQAATADVN

SEQ ID NO: 4534 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYSLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRAPAASETVA

SEQ ID NO: 4535 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDDGKFFPQSGVLIFGKQGATESDVDFDQVMITDEEEIRTTNPVATEQYGSVSTNLQAGNAQAATADVN

SEQ ID NO: 4536 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKDKFFPQSGVLIFGKQGSEKTNVDIEKVMITDEEEIRTTNPVATEQYGSVSTNLQAGNAQAATADVN

SEQ ID NO: 4537 - protein, 334 aa, Artificial Sequence; identical to SEQ ID NO: 1822
  Synthetic

SEQ ID NO: 4538 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTSADNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 4539 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHGDDNDKFFPQSGVLIFGKEDAGKTNIDIGQVMITDEEEIRTTNPVATEQYGSVSTNLQAGNAQAATADVN

SEQ ID NO: 4540 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGRTTPSGLSFSQAGASDIRDQSRNWLPGPCYRQQRVSKQSDWNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4541 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKEGSEKTNVDIEKVMITDEEEIRTTNPVATEQYGSVSTNLQAGNAQAATADVN

SEQ ID NO: 4542 - protein, 334 aa, Artificial Sequence; identical to SEQ ID NO: 43
  Synthetic

SEQ ID NO: 4543 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDTGRFFPQSGVLIFGKQGSGKDNVEVGQVMITDEEEIRTTNPVATEQYGSVSTNLQAGNAQAATADVN

SEQ ID NO: 4544 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSELVFSQAGASDIRDQSRNWLPGPCYRQQRVSKTHCDNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 4545 - protein, 334 aa, Artificial Sequence; identical to SEQ ID NO: 2734
  Synthetic

SEQ ID NO: 4546 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKESGRRSNVEIEQVMITDEEEIRTTNPVATEQYGSVSTNLQAGNAQAATADVN

SEQ ID NO: 4547 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKEGAGKTDVAIGRVMITDEEEIRTTNPVATEQYGSVSTNLQAGNAQAATADVN

SEQ ID NO: 4548 - protein, 334 aa, Artificial Sequence; identical to SEQ ID NO: 575
  Synthetic

SEQ ID NO: 4549 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDGKFFPQSGVLIFGKESAAAADTDIGNVMITDEEEIRTTNPVATEQYGSVSTNLQAGNAQAATADVN

SEQ ID NO: 4550 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4551 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTHGGITTMSQLRFSQAGASDIRDQSRNWLPGPCYRQQRVSTKDTDNNNSNFSWTGATKYHLNGRDSLVNPGPAMASHKDDEEKFFPQSGVLIFGKEGAGKANVEFERVMITDEEEIRTTNPVATEQYGSVSTNLQAGNAQAATADVN

SEQ ID NO: 4552 - protein, 334 aa, Artificial Sequence; identical to SEQ ID NO: 1065
  Synthetic

SEQ ID NO: 4553 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4554 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGASETNVEIDKVMITDEEEIRTTNPVATEQYGSVSTNLQAGNAQAATADVN

SEQ ID NO: 4555 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDEDKFFPQSGVLIFGKQGSAAANIEIEQVMITDEEEIRTTNPVATEQYGSVSTNLQAGNAQAATADVN

SEQ ID NO: 4556 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRDNRQAATADVN

SEQ ID NO: 4557 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDDGKFFPQSGVLIFGKQDTTRGNADVDQVMITDEEEIRTTNPVATEQYGSVSTNLQAGNAQAATADVN

SEQ ID NO: 4558 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTQPTENNNSDFSWTGATKYHLNGRDSLVNPGPAMASHGDDNDKFFPQSGVLIFGKQGSEKTNVDIEKVMITDEEEIRTTNPVATEQYGSVSTNLQRGNRQAATADVN

SEQ ID NO: 4559 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGTVTTSHLRFSQAGASDIRDQSRNWLPGPCYRQQRVSKQSDRNNNSEFSWTGATKYHLNGRDSLVNPGPAMASHKDDEDKFFPQSGVLIFGKQGAAGADVEVEKVMITDEEEIRTTNPVATEQYGSVSTNLQAGNAQAATADVN

SEQ ID NO: 4560 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTVTLSNLRFSQAGASDIRDQSRNWLPGPCYRQQRVSKQPNDNNNSEFSWTGATTYHLNGRDSLVNPGPAMASHKDDNEKFFPQSGVLIFGKQNGGGNNVDVDQVMITDEEEIRTTNPVATEQYGSVSTNLQRGNRQAATAYVN

SEQ ID NO: 4561 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSEYSWTGATKYHLNGRDSLVNPGPAMASHGDDDDKFFPQSGVLIFGKQGSEKTNVDIEKVMITDEEEIRTTNPVATEQYGSVSTNLQRGNRQAATADVN

SEQ ID NO: 4562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNRQAATADVN

SEQ ID NO: 4563 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDTTSELRFSQAGASDIRDQSRNWLPGPCYRQQRVSTKAGENNNSNFSWPGATTYHLNGRDSLVNPGPAMASHEDDADKFFPQSGVLIFGKQGAEASDADVEQVMITDEEEIRTTNPVATEQYGSVSTNLQAGNAQAATADVN

SEQ ID NO: 4564 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNDNSEFSWTGATKYHLNGRDSLVNPGPAMASHKDDEEKFFPQSGVLIFGKQGSEKTNVDIEKVMITDEEEIRTTNPVATEQYGSVSTNLQERSGAAAIEDVD

SEQ ID NO: 4565 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPAHSELVFSQAGASDIRDQSRNWLPGPCYRQQRVSKTHGDNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 4566 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGHDMTSELRFSQAGASDIRDQSRNWLPGPCYRQQRVSTTPGGNNNSNFSWTGATKYHLNGRDSLVNPGPAMASHKDDDDRFFPQSGVLIFGKESAKTSDAAVDDVMITDEEEIRTTNPVATEQYGSVSTNLQAGNAQAATADVN

SEQ ID NO: 4567 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQDAGATDVAVEEVMITDEEEIRTTNPVATEQYGSVSTNLQAGNAQAATADVN

SEQ ID NO: 4568 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDRFFPQSGVLIFGKQGSEKTNVDIEKVMITDEEEIRTTNPVATEQYGSVSTNLQRGNRQAATADVN

SEQ ID NO: 4569 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQNAGGNDIAIGEVMITDEEEIRTTNPVATEQYGSVSTNLQAGNAQAATADVN

SEQ ID NO: 4570 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQEKRGAAAVADVH

SEQ ID NO: 4571 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4572 - protein, 334 aa, Artificial Sequence; identical to SEQ ID NO: 3463
  Synthetic

SEQ ID NO: 4573 - protein, 334 aa, Artificial Sequence; identical to SEQ ID NO: 2553
  Synthetic

SEQ ID NO: 4574 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNARGTAAAQVVD

SEQ ID NO: 4575 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGTMTKSQLGFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4576 - protein, 334 aa, Artificial Sequence; identical to SEQ ID NO: 439
  Synthetic

SEQ ID NO: 4577 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTTTPSKLIFSQAGASDIRDQSRNWLPGPCYRQQRVSKQSDRNNNSEFSWTGATKYHLNGRDSLVNPGPAMASHEDDADKFFPQSGVLIFGKQGSEKTNVDIEKVMITDEEEIRTTNPVATEQYGSVSTNLQRGNRQAATADVN

SEQ ID NO: 4578 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENAGKGNITIDQVMITDEEEIRTTNPVATEQYGSVSTNLQAGNAQAATADVN

SEQ ID NO: 4579 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDTDNNNSNFSWTGATKYHLNGRDSLVNPGPAMASHRDDEDKFFPQSGVLIFGKQGGGATDVEIGNVMITDEEEIRTTNPVATEQYGSVSTNLQANKDPAAFKEVN

SEQ ID NO: 4580 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTYNDNNNSEFSWTGATTYHLNGRDSLVNPGPAMASHKDDEEKFFPQSGVLIFGKQGSEKTNVDIEKVMITDEEEIRTTNPVATEQYGSVSTNLQAPQDRAADTNVT

SEQ ID NO: 4581 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKQDSETANVDIGEVMITDEEEIRTTNPVATEQYGSVSTNLQRGNRQAATADVN

SEQ ID NO: 4582 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEESFFPQSGVLIFGKQNGEKGNIDIEGVMITDEEEIRTTNPVATEQYGSVSTNLQAGNAQAATADVN

SEQ ID NO: 4584 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDARTTDVAIDEVMITDEEEIRTTNPVATEQYGSVSTNLQAGNAQAATADVN

SEQ ID NO: 4585 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNLTTSELRFSQAGASDIRDQSRNWLPGPCYRQQRVSKQDTDNNNSEFSWTGATTYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4586 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKQSSDNNNSEFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGKTTAAFTMVT

SEQ ID NO: 4588 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4589 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4590 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKEHTRAAVNDVD

SEQ ID NO: 4591 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKRGAGKNNAAIGQVMITDEEEIRTTNPVATEQYGSVSTNLQAGNAQAATADVN

SEQ ID NO: 4592 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 4593 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDNGKFFPQSGVLIFGKENTTGNNVDIDRVMITDEEEIRTTNPVATEQYGSVSTNLQAGNAQAATADVN

SEQ ID NO: 4594 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSEPVFSQAGASDIRDQSRNWLPGPCYRQQRVSKTHGDNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 4595 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGIMTLSELRFSQAGASDIRDQSRNWLPGPCYRQQRVSTTPADNNDSDFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4596 - protein, 334 aa, Artificial Sequence; identical to SEQ ID NO: 512
  Synthetic

SEQ ID NO: 4597 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKENAGTTNVAFDKVMITDEEEIRTTNPVATEQYGSVSTNLQAGNAQAATADVN

SEQ ID NO: 4598 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKEDAGTTNVAFDKVMITDEEEIRTTNPVATEQYGSVSTNLQAGNAQAATADVN

SEQ ID NO: 4599 - protein, 334 aa, Artificial Sequence; identical to SEQ ID NO: 2639
  Synthetic

SEQ ID NO: 4600 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARGGAAVSNVN

SEQ ID NO: 4601 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDESGTTTNSRLGFSQAGASDIRDQSRNWLPGPCYRQQRVSKQDAENNNSDFSWTGATTYHLNGRDSLVNPGPAMASHKDDEESFFPQSGVLIFGKQDSEGANVEVGDVMITDEEEIRTTNPVATEQYGSVSTNLQAGNAQAATADVN

SEQ ID NO: 4602 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARSAAAVDGVA

SEQ ID NO: 4603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGDRTTAADRVVE

SEQ ID NO: 4604 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4605 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGGGKTNVDFESVMITDEEEIRTTNPVATEQYGSVSTNLQAGNAQAATADVN

SEQ ID NO: 4606 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTATMSKLHFSQAGASDIRDQSRNWLPGPCYRQQRVSKQPGDNNNSNFSWTGATKYHLNGRDSLVNPGPAMASHKDDDDRFFPQSGVLIFGKEGANGTNVEIGKVMITDEEEIRTTNPVATEQYGSVSTNLQAGNAQAATADVN

SEQ ID NO: 4607 - protein, 334 aa, Artificial Sequence; identical to SEQ ID NO: 412
  Synthetic

SEQ ID NO: 4608 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPSGTKTLSRLGFSQAGASDIRDQSRNWLPGPCYRQQRVSKKDAENNNSEFSWTGATKYHLNGRDSLVNPGPAMASHKDDEDKFFPQSGVLIFGKENGSAANADIEEVMITDEEEIRTTNPVATEQYGSVSTNLQAGNAQAATADVN

SEQ ID NO: 4609 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELMFSQAGASDIRDQSRNWLPGPCYRQQRVSTQSTGNNNSDFSWTGATKYHLNGRDSLVNPGPAMASHKDDDDRFFPQSGVLIFGKEGSAASNVDIGGVMITDEEEIRTTNPVATEQYGSVSTNLQAGNAQAATADVN

SEQ ID NO: 4610 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4611 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKTSADNNNSEFSWTGATKYHLNGRDSLVNPGPAMASHKDDEEKFFPQSGVLIFGKQSASRNDVAVGEVMITDEEEIRTTNPVATEQYGSVSTNLQAGNAQAATADVN

SEQ ID NO: 4612 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPADNNNSGFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 4613 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGGTDNVDIDRVMITDEEEIRTTNPVATEQYGSVSTNLQAGNAQAATADVN

SEQ ID NO: 4614 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTATMSKLHFSQAGASDIRDQSRNWLPGPCYRQQRVSTQSTGNNNSDFSWTGATKYHLNGRDSLVNPGPAMASHKDDDDRFFPQSGVLIFGKEGAGGNNVDFGEVMITDEEEIRTTNPVATEQYGSVSTNLQAGNAQAATADVN

SEQ ID NO: 4615 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDTDRFFPQSGVLIFGKQSAEKTNAEVDDVMITDEEEIRTTNPVATEQYGSVSTNLQAGNAQAATADVN

SEQ ID NO: 4616 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATTDVN

SEQ ID NO: 4617 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSELVFSQAGASDIRDQSRNWLPGPCYRQQRVSKTHGNNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 4618 - protein, 334 aa, Artificial Sequence
  Synthetic
QSGAPNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 4619 - protein, 334 aa, Artificial Sequence; identical to SEQ ID NO: 139
  Synthetic

SEQ ID NO: 4620 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQNAGANDVEVEGVMITDEEEIRTTNPVATEQYGSVSTNLQAGNAQAATADVN

SEQ ID NO: 4621 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 4622 - protein, 334 aa, Artificial Sequence; identical to SEQ ID NO: 327
  Synthetic

SEQ ID NO: 4623 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKDDRNNNSDFSWTGATKYHLNGRDSLVNPGPAMASHRDDNDKFFPQSGVLIFGKEGTARNNAAFDEVMITDEEEIRTTNPVATEQYGSVSTNLQAGNAQAATADVN

SEQ ID NO: 4624 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYNLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKEGAAAANIDIDKVMITDEEEIRTTNPVATEQYGSVSTNLQAGNAQAATADVN

SEQ ID NO: 4625 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGAGGDNVEVERVMITDEEEIRTTNPVATEQYGSVSTNLQAGNAQAATADVN

SEQ ID NO: 4626 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYPWTGATKYHLNGRDSLVNPGPAMASHKDDEEKFFPQSGVLIFGKENGKAGDVDIGNVMITDEEEIRTTNPVATEQYGSVSTNLQAGNAQAATADVN

SEQ ID NO: 4627 - protein, 334 aa, Artificial Sequence; identical to SEQ ID NO: 1206
  Synthetic

SEQ ID NO: 4628 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQDTERSNIDIERVMITDEEEIRTTNPVATEQYGSVSTNLQAGNAQAATADVN

SEQ ID NO: 4629 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKEGATRANVAIDEVMITDEEEIRTTNPVATEQYGSVSTNLQAGNAQAATADVN

SEQ ID NO: 4630 - protein, 334 aa, Artificial Sequence; identical to SEQ ID NO: 128
  Synthetic

SEQ ID NO: 4631 - protein, 334 aa, Artificial Sequence; identical to SEQ ID NO: 3279
  Synthetic

SEQ ID NO: 4632 - protein, 334 aa, Artificial Sequence; identical to SEQ ID NO: 79
  Synthetic

SEQ ID NO: 4633 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRNDTAAFTEVD

SEQ ID NO: 4634 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGIITPSDLRFSQAGASDIRDQSRNWLPGPCYRQQRVSETSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 4635 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGRVTPSRLGFSQAGASDIRDQSRNWLPGPCYRQQRVSKQPTGNNNSNFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 4636 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHSGHETTSTLEFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4637 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDRNNNSDFSWIGATKYHLNGRDSLVNPGPAMASHKDDDDRFFPQSGVLIFGKEGSAKADADIGDVMITDEEEIRTTNPVATEQYGSVSTNLQAGNAQAATADVN

SEQ ID NO: 4638 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLRQNKHPSGSPTHSELVFSQAGASDIRDQSRNWLPGPCYRQQRVSKTHGDNNNSNFSWTGATTYHLNGRDSLVNPGPAMASHKDDDDRFFPQSGVLIFGKEGAGANDVAVEHVMITDEEEIRTTNPVATEQYGSVSTNLQAGNAQAATADVN

SEQ ID NO: 4639 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4640 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTHTENNNSNFSWTGATTYHLNGRDSLVNPGPAMASHKDDNDRFFPQSGVLIFGKQGSEKTNVDIEKVMITDEEEIRTTNPVATEQYGSVSTNLQAGNTQAATADVN

SEQ ID NO: 4641 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGKATISGLKFSQAGASDIRDQSRNWLPGPCYRQQRVSKPHDDNNNSDFSWTGATTYHLNGRDSLVNPGPAMASHKDDDERFFPQSGVLIFGKQGSEKTNVEIEKVMITDEEEIRTTNPVATEQYGSVSTNLQAGNAQAATADVN

SEQ ID NO: 4642 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGNTTMSRLGFSQAGASDIRDQSRNWLPGPCYRQQRVSKQSDRNNNSEFSWTGATKYHLNGRDSLVNPGPAMASHKDDDDRFFPQSGVLIFGKQGSEKTNVDIEKVMITDEEEIRTTNPVATEQYGSVSTNLQACNAQAATADVN

SEQ ID NO: 4643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNPGGRETHSALRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4644 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGSPTHSELVFSQAGASDIRDQSRNWLPGPCYRQQRVSKTHGDNNNSNFSWTGATTYHLNGRDSLVNPGPAMASHKDDDDRFFPQSGVLIFGKECAGANDVAVEHVMITDEEEIRTTNPVATEQYGSVSTNLQAGNAQAATADVN

SEQ ID NO: 4645 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSNFSWTGATKYHLNGRDSLVNPGPAMASHKDDEDKFFPQSGVLIFGKEGASKTNIEYGQVMITDEEEIRTTNPVATEQYGSVSTNLQAGNAQAATADVN

SEQ ID NO: 4646 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQAGINTHSHLKFSQAGASDIRDQSRNWLPGPCYRQQRVSKKDAENNNSEFSWPGATTYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 4647 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 4648 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGTETTSRLQFSQAGASDIRDQSRNWLPGPCYRQQRVSKQPNYNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 4649 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGKFFPQSGVLIFGKQSADGSDVDIDRVMITDEEEIRTTNPVATEQYGSVSTNLQAGNAQAATADVN

SEQ ID NO: 4650 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSDFSWTGATTYHLNGRDSLVNPGPAMASHKDDDERFFPQSGVLIFGKQNAAANNADYESVMITDEEEIRTTNPVATEQYGSVSTNLQAGNAQAATADVN

SEQ ID NO: 4651 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAADTIVP

SEQ ID NO: 4652 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGRSPAAFTIVQ

SEQ ID NO: 4653 - protein, 334 aa, Artificial Sequence; identical to SEQ ID NO: 3342
  Synthetic

SEQ ID NO: 4654 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGNATPSELRFSQAGASDIRDQSRNWLPGPCYRQQRVSKTPNDNNNSNFSWTGATKYHLNGRDSLVNPGPAMASHKDDDERFFPQSGVLIFGKQSAKAANAAIDEVMITDEEEIRTTNPVATEQYGSVSTNLQAGNAQAATADVN

SEQ ID NO: 4655 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATISRLRFSQAGASDIRDQSRNWLPGPCYRQQRVSTTYNHNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4656 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQDAENNNSEFSWPGATKYHLNGRDSLVNPGPAMASHKDDEESFFPQSGVLIFGKEGGKGSDVDIGGVMITDEEEIRTTNPVATEQYGSVSTNLQAGNAQAATADVN

SEQ ID NO: 4657 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESATRGNVDIERVMITDEEEIRTTNPVATEQYGSVSTNLQAGNAQAATADVN

SEQ ID NO: 4658 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQSPAADRAVE

SEQ ID NO: 4659 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSETSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 4660 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGSHTTSGLGFSQAGASDIRDQSRNWLPGPCYRQQRVSKTPADNNNSDFSWTGATKYHLNGRDSLVNPGPAMASHKDDDDRFFPQSGVLIFGKQSGEKNDVDIDGVMITDEEEIRTTNPVATEQYGSVSTNLQAGNAQAATADVN

SEQ ID NO: 4661 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGGGSHTQSALRFSQAGASDIRDQSRNWLPGPCYRQQRVSKTPAENNNSNFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4662 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAPNSKAADNDVT

SEQ ID NO: 4663 - protein, 334 aa, Artificial Sequence; identical to SEQ ID NO: 789
  Synthetic

SEQ ID NO: 4664 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNQGGTVTLSNLRFSQAGASDIRDQSRNWLPGPCYRQQRVSKQPNDNNNSEFSWTGATTYHLNGRDSLVNPGPAMASHKDDNEKFFPQSGVLIFGKQNGGGNNVDVDQVMITDEEEIRTTNPVATEQYGSVSTNLQRGNRQAATADVN

SEQ ID NO: 4665 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGTTGANIDFDGVMITDEEEIRTTNPVATEQYGSVSTNLQAGNAQAATADVN

SEQ ID NO: 4666 - protein, 334 aa, Artificial Sequence; identical to SEQ ID NO: 3067
  Synthetic

SEQ ID NO: 4667 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTYAGNNNSNFSWTGATKYHLNGRDSLVNPGPAMASHKDDEEKFFPQSGVLIFGKEGAGTNDIDIERVMITDEEEIRTTNPVATEQYGSVSTNLQAGNAQAATADVN

SEQ ID NO: 4668 - protein, 334 aa, Artificial Sequence; identical to SEQ ID NO: 3727
  Synthetic

SEQ ID NO: 4669 - protein, 334 aa, Artificial Sequence; identical to SEQ ID NO: 840
  Synthetic

SEQ ID NO: 4670 - protein, 334 aa, Artificial Sequence; identical to SEQ ID NO: 30
  Synthetic

SEQ ID NO: 4671 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4672 - protein, 334 aa, Artificial Sequence; identical to SEQ ID NO: 401
  Synthetic

SEQ ID NO: 4673 - protein, 334 aa, Artificial Sequence; identical to SEQ ID NO: 31
  Synthetic

SEQ ID NO: 4674 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQSSDNNNSEFSWTGATKYHLNGRDSLVNPGPAMASHGDDDEKFFPQSGVLIFGKQGSEKTNVDIEKVMITDEEEIRTTNPVATEQYGSVSTNLQAGNAQAATADVN

SEQ ID NO: 4675 - protein, 334 aa, Artificial Sequence; identical to SEQ ID NO: 3726
  Synthetic

SEQ ID NO: 4676 - protein, 334 aa, Artificial Sequence; identical to SEQ ID NO: 422
  Synthetic

SEQ ID NO: 4677 - protein, 334 aa, Artificial Sequence; identical to SEQ ID NO: 597
  Synthetic

SEQ ID NO: 4678 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNAGNATMSNLKFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 4679 - protein, 334 aa, Artificial Sequence; identical to SEQ ID NO: 303
  Synthetic

SEQ ID NO: 4680 - protein, 334 aa, Artificial Sequence; identical to SEQ ID NO: 1559
  Synthetic

SEQ ID NO: 4681 - protein, 334 aa, Artificial Sequence; identical to SEQ ID NO: 561
  Synthetic

SEQ ID NO: 4682 - protein, 334 aa, Artificial Sequence; identical to SEQ ID NO: 509
  Synthetic

SEQ ID NO: 4683 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSTTPADNNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 4684 - protein, 334 aa, Artificial Sequence; identical to SEQ ID NO: 4055
  Synthetic

SEQ ID NO: 4685 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIERVMITDEEEIRTTNPVATEQYGSVSTNLQRGNRQAATADVN

SEQ ID NO: 4686 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRKGGAATNVVE

SEQ ID NO: 4687 - protein, 334 aa, Artificial Sequence; identical to SEQ ID NO: 573
  Synthetic

SEQ ID NO: 4688 - protein, 334 aa, Artificial Sequence; identical to SEQ ID NO: 4241
  Synthetic

SEQ ID NO: 4689 - protein, 334 aa, Artificial Sequence; identical to SEQ ID NO: 105
  Synthetic

SEQ ID NO: 4690 - protein, 334 aa, Artificial Sequence; identical to SEQ ID NO: 579
  Synthetic

SEQ ID NO: 4691 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDHRATAASNNVD

SEQ ID NO: 4692 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKGDEEKFFPQSGVLIFGKQGSEKTNVDIEKVMITDEEEIRTTNPVATEQYGSVSTNLQRGNRQAATADVN

SEQ ID NO: 4693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNGEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 4694 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHDRNNNSNFSWTGATKYHLNGRDSLVNPGPAMASHKDDEDKFFPQSGVLIFGKQGSEKTNVDIEKVMITDEEEIRTTNPVATEQYGSVSTNLQAGNTQAATADVN

SEQ ID NO: 4695 - protein, 334 aa, Artificial Sequence; identical to SEQ ID NO: 3966
  Synthetic

SEQ ID NO: 4696 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSEFRFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4697 - protein, 334 aa, Artificial Sequence; identical to SEQ ID NO: 233
  Synthetic

SEQ ID NO: 4698 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKEGASEAMPTSASVMITDEEEIRTTNPVATEQYGSVSTNLQAGNAQAATADVN

SEQ ID NO: 4699 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRANTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKENAGGDNVEIERVMITDEEEIRTTNPVATEQYGSVSTNLQAGNAQAATADVN

SEQ ID NO: 4700 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKEGAGKTNIAVDRVMITDEEEIRTTNPVATEQYGSVSTNLQAGNAQAATADVN

SEQ ID NO: 4701 - protein, 334 aa, Artificial Sequence; identical to SEQ ID NO: 3703
  Synthetic

SEQ ID NO: 4702 - protein, 334 aa, Artificial Sequence; identical to SEQ ID NO: 4057
  Synthetic

SEQ ID NO: 4703 - protein, 334 aa, Artificial Sequence; identical to SEQ ID NO: 2611
  Synthetic

SEQ ID NO: 4704 - protein, 334 aa, Artificial Sequence; identical to SEQ ID NO: 4151
  Synthetic

SEQ ID NO: 4705 - protein, 334 aa, Artificial Sequence; identical to SEQ ID NO: 4123
  Synthetic

SEQ ID NO: 4706 - protein, 334 aa, Artificial Sequence; identical to SEQ ID NO: 30
  Synthetic

SEQ ID NO: 4707 - protein, 334 aa, Artificial Sequence; identical to SEQ ID NO: 44
  Synthetic

SEQ ID NO: 4708 - protein, 334 aa, Artificial Sequence; identical to SEQ ID NO: 308
  Synthetic

SEQ ID NO: 4709 - protein, 334 aa, Artificial Sequence; identical to SEQ ID NO: 303
  Synthetic

SEQ ID NO: 4710 - protein, 334 aa, Artificial Sequence; identical to SEQ ID NO: 115
  Synthetic

SEQ ID NO: 4711 - protein, 334 aa, Artificial Sequence; identical to SEQ ID NO: 39
  Synthetic

SEQ ID NO: 4712 - protein, 334 aa, Artificial Sequence; identical to SEQ ID NO: 232
  Synthetic

SEQ ID NO: 4713 - protein, 334 aa, Artificial Sequence; identical to SEQ ID NO: 328
  Synthetic

SEQ ID NO: 4714 - protein, 334 aa, Artificial Sequence; identical to SEQ ID NO: 415
  Synthetic

SEQ ID NO: 4715 - protein, 334 aa, Artificial Sequence; identical to SEQ ID NO: 367
  Synthetic

SEQ ID NO: 4716 - protein, 334 aa, Artificial Sequence; identical to SEQ ID NO: 31
  Synthetic

SEQ ID NO: 4717 - protein, 334 aa, Artificial Sequence; identical to SEQ ID NO: 584
  Synthetic

SEQ ID NO: 4718 - protein, 334 aa, Artificial Sequence; identical to SEQ ID NO: 560
  Synthetic

SEQ ID NO: 4719 - protein, 334 aa, Artificial Sequence; identical to SEQ ID NO: 29
  Synthetic

SEQ ID NO: 4720 - protein, 334 aa, Artificial Sequence; identical to SEQ ID NO: 73
  Synthetic

SEQ ID NO: 4721 - protein, 334 aa, Artificial Sequence; identical to SEQ ID NO: 395
  Synthetic

SEQ ID NO: 4722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPHGPAADGMVN

SEQ ID NO: 4723 - protein, 334 aa, Artificial Sequence; identical to SEQ ID NO: 393
  Synthetic

SEQ ID NO: 4724 - protein, 334 aa, Artificial Sequence; identical to SEQ ID NO: 161
  Synthetic

SEQ ID NO: 4725 - protein, 334 aa, Artificial Sequence; identical to SEQ ID NO: 572
  Synthetic

SEQ ID NO: 4726 - protein, 334 aa, Artificial Sequence; identical to SEQ ID NO: 1043
  Synthetic

SEQ ID NO: 4727 - protein, 334 aa, Artificial Sequence; identical to SEQ ID NO: 377
  Synthetic

SEQ ID NO: 4728 - protein, 334 aa, Artificial Sequence; identical to SEQ ID NO: 479
  Synthetic

SEQ ID NO: 4729 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEEKFFPQSGVLIFGKEGASKNNIEIGSVMITDEEEIRTTNPVATEQYGSVSTNLQAGNAQAATADVN

SEQ ID NO: 4730 - protein, 334 aa, Artificial Sequence; identical to SEQ ID NO: 105
  Synthetic

SEQ ID NO: 4731 - protein, 334 aa, Artificial Sequence; identical to SEQ ID NO: 310
  Synthetic

SEQ ID NO: 4732 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGAGKNNAAIGQVMITDEEEIRTTNPVATEQYGSVSTNLQAGNAQAATADVN

SEQ ID NO: 4733 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQDTDNNNSEFSWTGATTYHLNGRDSLVNPGPAMASHKDDDEKFFPQSGVLIFGKESGNRNNIAFEEVMITDEEEIRTTNPVATEQYGSVSTNLQAGNAQAATADVN

SEQ ID NO: 4734 - protein, 334 aa, Artificial Sequence; identical to SEQ ID NO: 3727
  Synthetic

SEQ ID NO: 4735 - protein, 334 aa, Artificial Sequence; identical to SEQ ID NO: 206
  Synthetic

SEQ ID NO: 4736 - protein, 334 aa, Artificial Sequence; identical to SEQ ID NO: 124
  Synthetic

SEQ ID NO: 4737 - protein, 334 aa, Artificial Sequence; identical to SEQ ID NO: 94
  Synthetic

SEQ ID NO: 4738 - protein, 334 aa, Artificial Sequence; identical to SEQ ID NO: 244
  Synthetic

SEQ ID NO: 4739 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHEDDEGKFFPQSGVLIFGKQGSEKTNVDIEKVMITDEEEIRTTNPVATEQYGSVSTNLQAGNAQAATADVN

SEQ ID NO: 4740 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 4741 - protein, 334 aa, Artificial Sequence; identical to SEQ ID NO: 552
  Synthetic

SEQ ID NO: 4742 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 4743 - protein, 334 aa, Artificial Sequence; identical to SEQ ID NO: 274
  Synthetic

SEQ ID NO: 4744 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGAKGGNVAIDQVMITDEEEIRTTNPVATEQYGSVSTNLQAGNAQAATADVN

SEQ ID NO: 4745 - protein, 334 aa, Artificial Sequence; identical to SEQ ID NO: 619
  Synthetic

SEQ ID NO: 4746 - protein, 334 aa, Artificial Sequence; identical to SEQ ID NO: 96
  Synthetic

SEQ ID NO: 4747 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4748 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 4749 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPHDDNNNSDFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 4750 - protein, 334 aa, Artificial Sequence; identical to SEQ ID NO: 3202
  Synthetic

SEQ ID NO: 4751 - protein, 334 aa, Artificial Sequence; identical to SEQ ID NO: 576
  Synthetic

SEQ ID NO: 4752 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRAQAAATVVH

SEQ ID NO: 4753 - protein, 334 aa, Artificial Sequence; identical to SEQ ID NO: 3562
  Synthetic

SEQ ID NO: 4754 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGINTLSRLVFSQAGASDIRDQSRNWLPGPCYRQQRVSKTSADNNNSDFSWTGATKYHLNGRDSLVNPGPAMASHKDDDDRFFPQSGVLIFGKQSTSATNAAYEDVMITDEEEIRTTNPVATEQYGSVSTNLQAGNAQAATADVN

SEQ ID NO: 4755 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTHNNNSNFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 4756 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTPSALKFSQAGASDIRDQSRNWLPGPCYRQQRVSKTHGDNNNSNFSWTGATKYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 4757 - protein, 334 aa, Artificial Sequence; identical to SEQ ID NO: 506
  Synthetic

SEQ ID NO: 4758 - protein, 334 aa, Artificial Sequence; identical to SEQ ID NO: 237
  Synthetic

SEQ ID NO: 4759 - protein, 334 aa, Artificial Sequence; identical to SEQ ID NO: 665
  Synthetic

SEQ ID NO: 4760 - protein, 334 aa, Artificial Sequence; identical to SEQ ID NO: 400
  Synthetic

SEQ ID NO: 4761 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 4762 - protein, 334 aa, Artificial Sequence; identical to SEQ ID NO: 1698
  Synthetic

SEQ ID NO: 4763 - protein, 334 aa, Artificial Sequence; identical to SEQ ID NO: 335
  Synthetic

SEQ ID NO: 4764 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGLVTISDLRFSQAGASDIRDQSRNWLPGPCYRQQRVSKQPGDNNNSNFSWTGATKYHLNGRDSLVNPGPAMASHKDDDDRFFPQSGVLIFGKQDAGKSNADIDRVMITDEEEIRTTNPVATEQYGSVSTNLQAGNAQAATADVN

SEQ ID NO: 4765 - protein, 334 aa, Artificial Sequence; identical to SEQ ID NO: 380
  Synthetic

SEQ ID NO: 4766 - protein, 334 aa, Artificial Sequence; identical to SEQ ID NO: 883
  Synthetic

SEQ ID NO: 4767 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 4768 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANSNPAASDSVQ

SEQ ID NO: 4769 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4770 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTARGNADFESVMITDEEEIRTTNPVATEQYGSVSTNLQAGNAQAATADVN

SEQ ID NO: 4771 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4772 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDSAGTNTDIGQVMITDEEEIRTTNPVATEQYGSVSTNLQAGNAQAATADVN

SEQ ID NO: 4773 - protein, 334 aa, Artificial Sequence; identical to SEQ ID NO: 1477
  Synthetic

SEQ ID NO: 4774 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKEDSNGNNIAIDKVMITDEEEIRTTNPVATEQYGSVSTNLQAGNAQAATADVN

SEQ ID NO: 4775 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQSAKAANAAIDEVMITDEEEIRTTNPVATEQYGSVSTNLQAGNAQAATADVN

SEQ ID NO: 4776 - protein, 334 aa, Artificial Sequence; identical to SEQ ID NO: 1594
  Synthetic

SEQ ID NO: 4777 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSTKPADNNNSDFSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 4778 - protein, 334 aa, Artificial Sequence; identical to SEQ ID NO: 86
  Synthetic

SEQ ID NO: 4779 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQPSQNNNSNFSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 4780 - protein, 334 aa, Artificial Sequence; identical to SEQ ID NO: 446
  Synthetic

SEQ ID NO: 4781 - protein, 334 aa, Artificial Sequence; identical to SEQ ID NO: 1857
  Synthetic

SEQ ID NO: 4782 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQNAGRDDVAIEEVMITDEEEIRTTNPVATEQYGSVSTNLQAGNAQAATADVN

SEQ ID NO: 4783 - protein, 334 aa, Artificial Sequence; identical to SEQ ID NO: 2500
  Synthetic

SEQ ID NO: 4784 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 4785 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGGNNNSNFSWTGATKYHLNGRDSLVNPGPAMASHRDDNDKFFPQSGVLIFGKEGATGDNVEVEQVMITDEEEIRTTNPVATEQYGSVSTNLQAGNAQAATADVN

SEQ ID NO: 4786 - protein, 334 aa, Artificial Sequence; identical to SEQ ID NO: 98
  Synthetic

SEQ ID NO: 4787 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHKDDDDRFFPQSGVLIFGKEGADGSNVEIGNVMITDEEEIRTTNPVATEQYGSVSTNLQAGNAQAATADVN

SEQ ID NO: 4788 - protein, 334 aa, Artificial Sequence; identical to SEQ ID NO: 2749
  Synthetic

SEQ ID NO: 4789 - protein, 334 aa, Artificial Sequence; identical to SEQ ID NO: 632
  Synthetic

SEQ ID NO: 4790 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDDDRFFPQSGVLIFGKQSSSGNNIDIGNVMITDEEEIRTTNPVATEQYGSVSTNLQAGNAQAATADVN

SEQ ID NO: 4791 - protein, 334 aa, Artificial Sequence; identical to SEQ ID NO: 1556
  Synthetic

SEQ ID NO: 4792 - protein, 334 aa, Artificial Sequence; identical to SEQ ID NO: 315
  Synthetic

SEQ ID NO: 4793 - protein, 334 aa, Artificial Sequence; identical to SEQ ID NO: 416
  Synthetic

SEQ ID NO: 4794 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKTSADNNNSEYSWTGATKYHLNGRDSLVNPGPAMASHKDDEEKFFPQSGVLIFGKQGTNESDVDIEKVMITDEEEIRTTNPVATEQYGSVSTNLQAGNAQAATADVN

SEQ ID NO: 4795 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 4796 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGADGANVAYDRVMITDEEEIRTTNPVATEQYGSVSTNLQAGNAQAATADVN

SEQ ID NO: 4797 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSTKATDNNNSNFSWTGATTYHLNGRDSLVNPGPAMASHRDDAGKFFPQSGVLIFGKESAGKTNVAIGEVMITDEEEIRTTNPVATEQYGSVSTNLQAGNAQAATADVN

SEQ ID NO: 4798 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKTDNHNNNSNFSWTGATKYHLNGRDSLVNPGPAMASHGDDEGKFFPQSGVLIFGKQGSEKTNVDIEKVMITDEEEIRTTNPVATEQYGSVSTNLQAGNAQAATADVN

SEQ ID NO: 4799 - protein, 334 aa, Artificial Sequence; identical to SEQ ID NO: 3852
  Synthetic

SEQ ID NO: 4800 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSTTPADNNNSDFSWTGATKYHLNGRDSLVNPGPAMASHKDDDEKFFPQSGVLIFGKQGAAETDVDIENVMITDEEEIRTTNPVATEQYGSVSTNLQAGNAQAATADVN

SEQ ID NO: 4801 - protein, 334 aa, Artificial Sequence; identical to SEQ ID NO: 797
  Synthetic

SEQ ID NO: 4802 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQSAGANNVEIESVMITDEEEIRTTNPVATEQYGSVSTNLQAGNAQAATADVN

SEQ ID NO: 4803 - protein, 334 aa, Artificial Sequence; identical to SEQ ID NO: 376
  Synthetic

SEQ ID NO: 4804 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKAGLATKSDLMFSQAGASDIRDQSRNWLPGPCYRQQRVSKVSADNNNSEFSWTGATKYHLNGRDSLVNPGPAMASHKDDEEKFFPQSGVLIFGKEGATKSNAAFEEVMITDEEEIRTTNPVATEQYGSVSTNLQAGNAQAATADVN

SEQ ID NO: 4805 - protein, 334 aa, Artificial Sequence; identical to SEQ ID NO: 426
  Synthetic

SEQ ID NO: 4806 - protein, 334 aa, Artificial Sequence; identical to SEQ ID NO: 516
  Synthetic

SEQ ID NO: 4807 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQHNQNNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 4808 - protein, 334 aa, Artificial Sequence; identical to SEQ ID NO: 43
  Synthetic

SEQ ID NO: 4809 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDNDKFFPQSGVLIFGKENAAKGNTAIDEVMITDEEEIRTTNPVATEQYGSVSTNLQAGNAQAATADVN

SEQ ID NO: 4810 - protein, 334 aa, Artificial Sequence; identical to SEQ ID NO: 833
  Synthetic

SEQ ID NO: 4811 - protein, 334 aa, Artificial Sequence; identical to SEQ ID NO: 1737
  Synthetic

SEQ ID NO: 4812 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 4813 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEDRFFPQSGVLIFGKQGGKEDNVDVDQVMITDEEEIRTTNPVATEQYGSVSTNLQAGNAQAATADVN

SEQ ID NO: 4814 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEDSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 4815 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQGAGKDDVDIGGVMITDEEEIRTTNPVATEQYGSVSTNLQAGNAQAATADVN

SEQ ID NO: 4816 - protein, 334 aa, Artificial Sequence; identical to SEQ ID NO: 2251
  Synthetic

SEQ ID NO: 4817 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGIQTQSRLGFSQAGASDIRDQSRNWLPGPCYRQQRVSKTYNDNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4818 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHDRNNNSNFSWTGATKYHLNGRDSLVNPGPAMASHKDDEDKFFPQSGVLIFGKEDAGAANVEFGQVMITDEEEIRTTNPVATEQYGSVSTNLQAGNAQAATADVN

SEQ ID NO: 4819 - protein, 334 aa, Artificial Sequence; identical to SEQ ID NO: 3896
  Synthetic

SEQ ID NO: 4820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGNTTMSRLGFSQAGASDIRDQSRNWLPGPCYRQQRVSKTPDGNNNSDFSWTGATKYHLNGRDSLVNPGPAMASHRDDDEKFFPQSGVLIFGKQDAAGTNIAFDQVMITDEEEIRTTNPVATEQYGSVSTNLQAGNAQAATADVN

SEQ ID NO: 4821 - protein, 334 aa, Artificial Sequence; identical to SEQ ID NO: 75
  Synthetic

SEQ ID NO: 4822 - protein, 334 aa, Artificial Sequence; identical to SEQ ID NO: 276
  Synthetic

SEQ ID NO: 4823 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGHPTLSTLLFSQAGASDIRDQSRNWLPGPCYRQQRVSTQADRNNNSNFSWTGATTYHLNGRDSLVNPGPAMASHGDDTDKFFPQSGVLIFGKQSAKAANAAIDEVMITDEEEIRTTNPVATEQYGSVSTNLQAGNAQAATADVN

SEQ ID NO: 4824 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRNQAAFAVVA

SEQ ID NO: 4825 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGIVTLSGLRFSQAGASDIRDQSRNWLPGPCYRQQRVSKTDGENNNSDFSWTGATKYHLNGRDSLVNPGPAMASHKDDEEKFFPQSGVLIFGKEGGAKNNVAIEHVMITDEEEIRTTNPVATEQYGSVSTNLQAGNAQAATADVN

SEQ ID NO: 4826 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKEGGAGADVDIGQVMITDEEEIRTTNPVATEQYGSVSTNLQAGNAQAATADVN

SEQ ID NO: 4827 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEERFFPQSGVLIFGKQGSEKTNVDIEKVMITDEEEIRTTNPVATEQYGSVSTNLQAGNAQAATADVN

SEQ ID NO: 4828 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHRDDAGRFFPQSGVLIFGKENAGKSDVEIEHVMITDEEEIRTTNPVATEQYGSVSTNLQAGNAQAATADVN

SEQ ID NO: 4829 - protein, 334 aa, Artificial Sequence; identical to SEQ ID NO: 1288
  Synthetic

SEQ ID NO: 4830 - protein, 334 aa, Artificial Sequence; identical to SEQ ID NO: 153
  Synthetic

SEQ ID NO: 4831 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKEGANGTNVEIGKVMITDEEEIRTTNPVATEQYGSVSTNLQAGNAQAATADVN

SEQ ID NO: 4832 - protein, 334 aa, Artificial Sequence; identical to SEQ ID NO: 457
  Synthetic

SEQ ID NO: 4833 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGTGKANIDIDKVMITDEEEIRTTNPVATEQYGSVSTNLQAGNAQAATADVN

SEQ ID NO: 4834 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGLDTTSRLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4835 - protein, 334 aa, Artificial Sequence; identical to SEQ ID NO: 2639
  Synthetic

SEQ ID NO: 4836 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDRFFPQSGVLIFGKQNAATDNVDVEHVMITDEEEIRTTNPVATEQYGSVSTNLQAGNAQAATADVN

SEQ ID NO: 4837 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTDGENNNSDFSWTGATKYHLNGRDSLVNPGPAMASHKDDEEKFFPQSGVLIFGKEGTTGNDIDIERVMITDEEEIRTTNPVATEQYGSVSTNLQAGNAQAATADVN

SEQ ID NO: 4838 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDAEKFFPQSGVLIFGKQGTKKGDVDFGQVMITDEEEIRTTNPVATEQYGSVSTNLQAGNAQAATADVN

SEQ ID NO: 4839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQNAAKANVDIGDVMITDEEEIRTTNPVATEQYGSVSTNLQAGNAQAATADVN

SEQ ID NO: 4840 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKEDGDGANVAIDRVMITDEEEIRTTNPVATEQYGSVSTNLQAGNAQAATADVN

SEQ ID NO: 4841 - protein, 334 aa, Artificial Sequence
  Synthetic
ATGANNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKQGAGKSNVDNGQVMITDEEEIRTTNPVATEQYGSVSTNLQAGNAQAATADVN

SEQ ID NO: 4842 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQASDNNNSEFSWTGATKYHLNGRDSLVNPGPAMASHKDDEEKFFPQSGVLIFGKQSSSGNNIEIEDVMITDEEEIRTTNPVATEQYGSVSTNLQAGNAQAATADVN

SEQ ID NO: 4843 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGPETKSKLLFSQAGASDIRDQSRNWLPGPCYRQQRVSKVSADNNNSEFSWTGATKYHLNGRDSLVNPGPAMASHKDDEEKFFPQSGVLIFGKEGAAGTNTDIGRVMITDEEEIRTTNPVATEQYGSVSTNLQAGNAQAATADVN

SEQ ID NO: 4844 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHEDDTGRFFPQSGVLIFGKQGSRKGNVDIEEVMITDEEEIRTTNPVATEQYGSVSTNLQAGNAQAATADVN

SEQ ID NO: 4845 - protein, 334 aa, Artificial Sequence; identical to SEQ ID NO: 4555
  Synthetic

SEQ ID NO: 4846 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHGDDDDKFFPQSGVLIFGKQGTGKDNVAIGGVMITDEEEIRTTNPVATEQYGSVSTNLQAGNAQAATADVN

SEQ ID NO: 4847 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKQASDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4848 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTSADNNNSEYSWTGATKYHLNGRDSLVNPGPAMASHGDDNDKFFPQSGVLIFGKEGAGKTNIAVDRVMITDEEEIRTTNPVATEQYGSVSTNLQAGNAQAATADVN

SEQ ID NO: 4849 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGHNTHSTLMFSQAGASDIRDQSRNWLPGPCYRQQRVSKTHGDNNNSNFSWTGATTYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 4850 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGSTTHSKLGFSQAGASDIRDQSRNWLPGPCYRQQRVSTTSSENNNSDFSWPGATTYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 4851 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSGATNIEVEQVMITDEEEIRTTNPVATEQYGSVSTNLQAGNAQAATADVN

SEQ ID NO: 4852 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAEKNDIDIGRVMITDEEEIRTTNPVATEQYGSVSTNLQAGNAQAATADVN

SEQ ID NO: 4853 - protein, 334 aa, Artificial Sequence; identical to SEQ ID NO: 1331
  Synthetic

SEQ ID NO: 4854 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQDANRNNVEIGQVMITDEEEIRTTNPVATEQYGSVSTNLQAGNAQAATADVN

SEQ ID NO: 4855 - protein, 334 aa, Artificial Sequence; identical to SEQ ID NO: 1275
  Synthetic

SEQ ID NO: 4856 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHKDDEGRFFPQSGVLIFGKQNGGTGNVAIDRVMITDEEEIRTTNPVATEQYGSVSTNLQAGNAQAATADVN

SEQ ID NO: 4857 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNTAATTNVD

SEQ ID NO: 4858 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDSGRADVAFESVMITDEEEIRTTNPVATEQYGSVSTNLQAGNAQAATADVN

SEQ ID NO: 4859 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQSAKAANAAIDEVMITDEEEIRTTNPVATEQYGSVSTNLQAGNAQAATADVN

SEQ ID NO: 4860 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSRSRAAFEDVT

SEQ ID NO: 4861 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSITMSGLRFSQAGASDIRDQSRNWLPGPCYRQQRVSTTPNENNNSDFSWTGATKYHLNGRDSLVNPGPAMASHRDDEDKFFPQSGVLIFGKEGSEKTNVDIEKVMITDEEEIRTTNPVATEQYGSVSTNLQRGNRQAATADVN

SEQ ID NO: 4862 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDRFFPQSGVLIFGKQGTEGNDIDIGNVMITDEEEIRTTNPVATEQYGSVSTNLQAGNAQAATADVN

SEQ ID NO: 4863 - protein, 334 aa, Artificial Sequence; identical to SEQ ID NO: 476
  Synthetic

SEQ ID NO: 4864 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGTGGSDVAIDNVMITDEEEIRTTNPVATEQYGSVSTNLQAGNAEAATADVN

SEQ ID NO: 4865 - protein, 334 aa, Artificial Sequence; identical to SEQ ID NO: 2408
  Synthetic

SEQ ID NO: 4866 - protein, 334 aa, Artificial Sequence; identical to SEQ ID NO: 487
  Synthetic

SEQ ID NO: 4867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGRFFPQSGVLIFGKQNAGKDDVDIDQVMITDEEEIRTTNPVATEQYGSVSTNLQAGNAQAATADVN

SEQ ID NO: 4868 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDGSTTNVDIGGVMITDEEEIRTTNPVATEQYGSVSTNLQAGNAQAATADVN

SEQ ID NO: 4869 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4870 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRDRAAVKEVA

SEQ ID NO: 4871 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTAGPLTPSRLQFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4872 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRAQTRAADAAVH

SEQ ID NO: 4873 - protein, 334 aa, Artificial Sequence; identical to SEQ ID NO: 548
  Synthetic

SEQ ID NO: 4874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGSGKSNTDFDSVMITDEEEIRTTNPVATEQYGSVSTNLQAGNAQAATADVN

SEQ ID NO: 4875 - protein, 334 aa, Artificial Sequence; identical to SEQ ID NO: 2217
  Synthetic

SEQ ID NO: 4876 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRNSAAFREVN

SEQ ID NO: 4877 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTDKFFPQSGVLIFGKQGSEKTNVDIEKVMITDEEEIRTTNPVATEQYGSVSTNLQAGNAQAATADVN

SEQ ID NO: 4878 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQSAKAANAAIDEVMITDEEEIRTTNPVATEQYGSVSTNLQAGNAQAATADVN

SEQ ID NO: 4879 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQSGTRANVAIGEVMITDEEEIRTTNPVATEQYGSVSTNLQAGNAQAATADVN

SEQ ID NO: 4880 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGGNGNNVEIESVMITDEEEIRTTNPVATEQYGSVSTNLQAGNAQAATADVN

SEQ ID NO: 4881 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKEDSGKNNVDIGRVMITDEEEIRTTNPVATEQYGSVSTNLQAGNAQAATADVN

SEQ ID NO: 4882 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDKRDGAAFKVVD

SEQ ID NO: 4883 - protein, 334 aa, Artificial Sequence; identical to SEQ ID NO: 545
  Synthetic

SEQ ID NO: 4884 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSADNNNSEYSWTGATKYHLNGRDSLVNPGPAMASHKDDEEKFFPQSGVLIFGKEDAGKADVEIGKVMITDEEEIRTTNPVATEQYGSVSTNLQAGNAQAATADVN

SEQ ID NO: 4885 - protein, 334 aa, Artificial Sequence; identical to SEQ ID NO: 357
  Synthetic

SEQ ID NO: 4886 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGTNGANIAIEGVMITDEEEIRTTNPVATEQYGSVSTNLQAGNAQAATADVN

SEQ ID NO: 4887 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 4888 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTVTTSGLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4889 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGTGASNADIDHVMITDEEEIRTTNPVATEQYGSVSTNLQAGNAQAATADVN

SEQ ID NO: 4890 - protein, 334 aa, Artificial Sequence; identical to SEQ ID NO: 1588
  Synthetic

SEQ ID NO: 4891 - protein, 334 aa, Artificial Sequence; identical to SEQ ID NO: 1262
  Synthetic

SEQ ID NO: 4892 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKVSADNNNSEFSWTGATKYHLNGRDSLVNPGPAMASHKDDEEKFFPQSGVLIFGKQNATGTNVDVGSVMITDEEEIRTTNPVATEQYGSVSTNLQAGNAQAATADVN

SEQ ID NO: 4893 - protein, 334 aa, Artificial Sequence; identical to SEQ ID NO: 1606
  Synthetic

SEQ ID NO: 4894 - protein, 334 aa, Artificial Sequence; identical to SEQ ID NO: 629
  Synthetic

SEQ ID NO: 4895 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDRFFPQSGVLIFGKQGSEKTNVDIEKVMITDEEEIRTTNPVATEQYGSVSTNLQAGNAQAATADVN

SEQ ID NO: 4896 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4897 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSEFSWPGATKYHLNGRDSLVNPGPAMASHKDDEEKFFPQSGVLIFGKEGSTATDVDIGRVMITDEEEIRTTNPVATEQYGSVSTNLQAGNAQAATADVN

SEQ ID NO: 4898 - protein, 334 aa, Artificial Sequence; identical to SEQ ID NO: 4686
  Synthetic

SEQ ID NO: 4899 - protein, 334 aa, Artificial Sequence; identical to SEQ ID NO: 1848
  Synthetic

SEQ ID NO: 4900 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATRAQAAVDNVN

SEQ ID NO: 4901 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKTSADNNNSEYSWTGATKYHLNGRDSLVNPGPAMASHKDDDDKFFPQSGVLIFGKEDGNAANVDIDQVMITDEEEIRTTNPVATEQYGSVSTNLQAGNAQAATADVN

SEQ ID NO: 4902 - protein, 334 aa, Artificial Sequence; identical to SEQ ID NO: 2829
  Synthetic

SEQ ID NO: 4903 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHDTQSTLKFSQAGASDIRDQSRNWLPGPCYRQQRVSKTHGDNNNSNFSWTGATTYHLNGRDSLVNPGPAMASHKDDAEKFFPQSGVLIFGKEGANGGNADIEDVMITDEEEIRTTNPVATEQYGSVSTNLQAGNAQAATADVN

SEQ ID NO: 4904 - protein, 334 aa, Artificial Sequence; identical to SEQ ID NO: 3917
  Synthetic

SEQ ID NO: 4905 - protein, 334 aa, Artificial Sequence; identical to SEQ ID NO: 2855
  Synthetic

SEQ ID NO: 4906 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGHPTLSQLKFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 4907 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQGNKGSAAVDIVT

SEQ ID NO: 4908 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGINTNSDLKFSQAGASDIRDQSRNWLPGPCYRQQRVSKTDGENNNSDFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4909 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSKQASDNNNSEFSWTGATKYHLNGRDSLVNPGPAMASHKDDEEKFFPQSGVLIFGKENAAGGDAEIGEVMITDEEEIRTTNPVATEQYGSVSTNLQAGNAQAATADVN

SEQ ID NO: 4910 - protein, 334 aa, Artificial Sequence; identical to SEQ ID NO: 1585
  Synthetic

SEQ ID NO: 4911 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGPQTTSTLRFSQAGASDIRDQSRNWLPGPCYRQQRVSKTYNDNNNSEFSWTGATTYHLNGRDSLVNPGPAMASHKDDEEKFFPQSGVLIFGKQNSKGADVAIGEVMITDEEEIRTTNPVATEQYGSVSTNLQAGNAQAATADVN

SEQ ID NO: 4912 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKENSRAGNVDIEEVMITDEEEIRTTNPVATEQYGSVSTNLQAGNAQAATADVN

SEQ ID NO: 4913 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 4914 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKTSDGNNNSDFSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 4915 - protein, 334 aa, Artificial Sequence; identical to SEQ ID NO: 399
  Synthetic

SEQ ID NO: 4916 - protein, 334 aa, Artificial Sequence; identical to SEQ ID NO: 575
  Synthetic

SEQ ID NO: 4917 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGTANAGVGEVMITDEEEIRTTNPVATEQYGSVSTNLQAGNAQAATADVN

SEQ ID NO: 4918 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHSGPTTPSSLVFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4919 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTRDHAASAVVK

SEQ ID NO: 4920 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSEFSWTGATKYHLNGRDSLVNPGPAMASHKDDEEKFFPQSGVLIFGKQSATKNNIAIEHVMITDEEEIRTTNPVATEQYGSVSTNLQAGNAQAATADVN

SEQ ID NO: 4921 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQQTPAASTTVH

SEQ ID NO: 4922 - protein, 334 aa, Artificial Sequence; identical to SEQ ID NO: 427
  Synthetic

SEQ ID NO: 4923 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNASGLVTISDLRFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 4924 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEDGSEDNVAIEQVMITDEEEIRTTNPVATEQYGSVSTNLQAGNAQAATADVN

SEQ ID NO: 4925 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGTTGANVAYEDVMITDEEEIRTTNPVATEQYGSVSTNLQAGNAQAATADVN

SEQ ID NO: 4926 - protein, 334 aa, Artificial Sequence; identical to SEQ ID NO: 322
  Synthetic

SEQ ID NO: 4927 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKQSDHNNNSNFSWTGATKYHLNGRDSLVNPGPAMASHKDDDDKFFPQSGVLIFGKEGATKANAEVDSVMITDEEEIRTTNPVATEQYGSVSTNLQAGNAQAATADVN

SEQ ID NO: 4928 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGRETISRLGFSQAGASDIRDQSRNWLPGPCYRQQRVSTTPSENNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 4929 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTTGHATLSTLKFSQAGASDIRDQSRNWLPGPCYRQQRVSKTYNHNNNSEFSWTGATKYHLNGRDSLVNPGPAMASHKDDEDKFFPQSGVLIFGKQDAAGNNVAIEEVMITDEEEIRTTNPVATEQYGSVSTNLQAGNAQAATADVN

SEQ ID NO: 4930 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGNDTLSQLRFSQAGASDIRDQSRNWLPGPCYRQQRVSTTPTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4931 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDTGKFFPQSGVLIFGKQGSEKTNVDIEKVMITDEEEIRTTNPVATEQYGSVSTNLQAGNAQAATADVN

SEQ ID NO: 4932 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGAGANDVAVEHVMITDEEEIRTTNPVATEQYGSVSTNLQAGNAQAATADVN

SEQ ID NO: 4933 - protein, 334 aa, Artificial Sequence; identical to SEQ ID NO: 383
  Synthetic

SEQ ID NO: 4934 - protein, 334 aa, Artificial Sequence; identical to SEQ ID NO: 566
  Synthetic

SEQ ID NO: 4935 - protein, 334 aa, Artificial Sequence; identical to SEQ ID NO: 792
  Synthetic

SEQ ID NO: 4936 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTYNDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 4937 - protein, 334 aa, Artificial Sequence; identical to SEQ ID NO: 382
  Synthetic

SEQ ID NO: 4938 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGNTTKSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 4939 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGSTKGNTAIDHVMITDEEEIRTTNPVATEQYGSVSTNLQAGNAQAATADVN

SEQ ID NO: 4940 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSEYSWTGATKYHLNGRDSLVNPGPAMASHEDDADKFFPQSGVLIFGKQGSEKTNVDIEKVMITDEEEIRTTNPVATEQYGSVSTNLQRGNRQAATADVN

SEQ ID NO: 4941 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKEGAGRDDVDVEEVMITDEEEIRTTNPVATEQYGSVSTNLQAGNAQAATADVN

SEQ ID NO: 4942 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDERFFPQSGVLIFGKQGSEKTNVDIEKVMITDEEEIRTTNPVATEQYGSVSTNLQAGNAQAATADVN

SEQ ID NO: 4943 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKESGERADVDVEQVMITDEEEIRTTNPVATEQYGSVSTNLQAGNAQAATADVN

SEQ ID NO: 4944 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEDGRKGDVEIGSVMITDEEEIRTTNPVATEQYGSVSTNLQAGNAQAATADVN

SEQ ID NO: 4945 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDTGRFFPQSGVLIFGKQGSEKTNVDIEKVMITDEEEIRTTNPVATEQYGSVSTNLQAGNAQAATADVN

SEQ ID NO: 4946 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSARSNADFDGVMITDEEEIRTTNPVATEQYGSVSTNLQAGNAQAATADVN

SEQ ID NO: 4947 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKTDGENNNSDFSWTGATKYHLNGRDSLVNPGPAMASHKDDEEKFFPQSGVLIFGKENSGKSDVDVDRVMITDEEEIRTTNPVATEQYGSVSTNLQAGNAQAATADVN

SEQ ID NO: 4948 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 4949 - protein, 334 aa, Artificial Sequence; identical to SEQ ID NO: 2452
  Synthetic

SEQ ID NO: 4950 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLIFSQAGASDIRDQSRNWLPGPCYRQQRVSKTSADNNNSEYSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 4951 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRQSQAAFSMVN

SEQ ID NO: 4952 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGTNETNIDIDGVMITDEEEIRTTNPVATEQYGSVSTNLQAGNAQAATADVN

SEQ ID NO: 4953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQGAAGTNAAIERVMITDEEEIRTTNPVATEQYGSVSTNLQAGNAQAATADVN

SEQ ID NO: 4954 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDEEKFFPQSGVLIFGKQGANTNNTAIDSVMITDEEEIRTTNPVATEQYGSVSTNLQAGNAQAATADVN

SEQ ID NO: 4955 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSSGNHTISPLRFSQAGASDIRDQSRNWLPGPCYRQQRVSKTPNGNNNSDFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 4956 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQSAGKTNTEYDKVMITDEEEIRTTNPVATEQYGSVSTNLQAGNAQAATADVN

SEQ ID NO: 4957 - protein, 334 aa, Artificial Sequence; identical to SEQ ID NO: 2734
  Synthetic

SEQ ID NO: 4958 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSTENNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 4959 - protein, 334 aa, Artificial Sequence; identical to SEQ ID NO: 385
  Synthetic

SEQ ID NO: 4960 - protein, 334 aa, Artificial Sequence; identical to SEQ ID NO: 874
  Synthetic

SEQ ID NO: 4961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGQTTAAYAGVE

SEQ ID NO: 4962 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKQGTAGANAAIDNVMITDEEEIRTTNPVATEQYGSVSTNLQAGNAQAATADVN

SEQ ID NO: 4963 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 4964 - protein, 334 aa, Artificial Sequence; identical to SEQ ID NO: 1473
  Synthetic

SEQ ID NO: 4965 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNKTGITTQSRLQFSQAGASDIRDQSRNWLPGPCYRQQRVSKTSADNNNSDFSWTGATKYHLNGRDSLVNPGPAMASHKDDDERFFPQSGVLIFGKQDANRNNADVDHVMITDEEEIRTTNPVATEQYGSVSTNLQAGNAQAATADVN

SEQ ID NO: 4966 - protein, 334 aa, Artificial Sequence; identical to SEQ ID NO: 509
  Synthetic

SEQ ID NO: 4967 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDGKGSNIAIEGVMITDEEEIRTTNPVATEQYGSVSTNLQAGNAQAATADVN

SEQ ID NO: 4968 - protein, 334 aa, Artificial Sequence; identical to SEQ ID NO: 1256
  Synthetic

SEQ ID NO: 4969 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENTTGNDAEIGQVMITDEEEIRTTNPVATEQYGSVSTNLQAGNAQAATADVN

SEQ ID NO: 4970 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGNDTLSQLRFSQAGASDIRDQSRNWLPGPCYRQQRVSKTPNGNNNSDFSWTGATKYHLNGRDSLVNPGPAMASHGDDNDRFFPQSGVLIFGKEGSGGGNVEFEGVMITDEEEIRTTNPVATEQYGSVSTNLQAGNAQAATADVN

SEQ ID NO: 4971 - protein, 334 aa, Artificial Sequence; identical to SEQ ID NO: 3697
  Synthetic

SEQ ID NO: 4972 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERRTSAATAVVN

SEQ ID NO: 4973 - protein, 334 aa, Artificial Sequence; identical to SEQ ID NO: 4691
  Synthetic

SEQ ID NO: 4974 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRGQAASGAVN

SEQ ID NO: 4975 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQNGEKGNIDIEGVMITDEEEIRTTNPVATEQYGSVSTNLQAGNAQAATADVN

SEQ ID NO: 4976 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNETGNATPSRLKFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 4977 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 4978 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQSDRNNNSEFSWTGATKYHLNGRDSLVNPGPAMASHKDDEDKFFPQSGVLIFGKEDAGTTNVAFDKVMITDEEEIRTTNPVATEQYGSVSTNLQAGNAQAATADVN

SEQ ID NO: 4979 - protein, 334 aa, Artificial Sequence; identical to SEQ ID NO: 2596
  Synthetic

SEQ ID NO: 4980 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTRSGAATRDVA

SEQ ID NO: 4981 - protein, 334 aa, Artificial Sequence; identical to SEQ ID NO: 1156
  Synthetic

SEQ ID NO: 4982 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKGRFFPQSGVLIFGKQGAAETNADFEEVMITDEEEIRTTNPVATEQYGSVSTNLQAGNAQAATADVN

SEQ ID NO: 4983 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDERFFPQSGVLIFGKEGGDEADVDIDRVMITDEEEIRTTNPVATEQYGSVSTNLQAGNAQAATADVN

SEQ ID NO: 4984 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNERTTAAFHTVD

SEQ ID NO: 4985 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGTKTTSELLFSQAGASDIRDQSRNWLPGPCYRQQRVSTQSGGNNNSNFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 4986 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGAARSNVAFEQVMITDEEEIRTTNPVATEQYGSVSTNLQAGNAQAATADVN

SEQ ID NO: 4987 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQRGNRQAATADVN

SEQ ID NO: 4988 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTGANNAEIGEVMITDEEEIRTTNPVATEQYGSVSTNLQAGNAQAATADVN

SEQ ID NO: 4989 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKQGARAANIDIGQVMITDEEEIRTTNPVATEQYGSVSTNLQAGNAQAATADVN

SEQ ID NO: 4990 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTPAAFDIVA

SEQ ID NO: 4991 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTTTPSKLIFSQAGASDIRDQSRNWLPGPCYRQQRVSTKSNENNNSDFSWTGATTYHLNGRDSLVNPGPAMASHKDDEEKFFPQSGVLIFGKQGAGANNVAIGDVMITDEEEIRTTNPVATEQYGSVSTNLQAGNAQAATADVN

SEQ ID NO: 4992 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQDSNGANTEIGDVMITDEEEIRTTNPVATEQYGSVSTNLQAGNAQAATADVN

SEQ ID NO: 4993 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKESSGEGNVDVDSVMITDEEEIRTTNPVATEQYGSVSTNLQAGNAQAATADVN

SEQ ID NO: 4994 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHAGSHTMSSLRFSQAGASDIRDQSRNWLPGPCYRQQRVSKTDGENNNSDFSWTGATKYHLNGRDSLVNPGPAMASHKDDEEKFFPQSGVLIFGKQSGGRSNVEIDQVMITDEEEIRTTNPVATEQYGSVSTNLQAGNAQAATADVN

SEQ ID NO: 4995 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARNGQAAIDVVH

SEQ ID NO: 4996 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQSAKGGNVEYGDVMITDEEEIRTTNPVATEQYGSVSTNLQAGNAQAATADVN

SEQ ID NO: 4997 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDKDKFFPQSGVLIFGKQDTAKNNVDIDSVMITDEEEIRTTNPVATEQYGSVSTNLQAGNAQAATADVN

SEQ ID NO: 4998 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTAGPKTQSPLRFSQAGASDIRDQSRNWLPGPCYRQQRVSKTHGDNNNSNFSWTGATTYHLNGRDSLVNPGPAMASHKDDADKFFPQSGVLIFGKEGAGKADIEIGKVMITDEEEIRTTNPVATEQYGSVSTNLQAGNAQAATADVN

SEQ ID NO: 4999 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARTGTVTNSKLQFSQAGASDIRDQSRNWLPGPCYRQQRVSKTSADNNNSEFSWTGATKYHLNGRDSLVNPGPAMASHGDDADKFFPQSGVLIFGKQGSEKTNVDIEKVMITDEEEIRTTNPVATEQYGSVSTNLQAGNAQAATADVN

SEQ ID NO: 5000 - protein, 334 aa, Artificial Sequence; identical to SEQ ID NO: 1529
  Synthetic

SEQ ID NO: 5001 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGTNTMSTLQFSQAGASDIRDQSRNWLPGPCYRQQRVSKTYNDNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5002 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHGDDADKFFPQSGVLIFGKESGEKNNIDIDGVMITDEEEIRTTNPVATEQYGSVSTNLQAGNAQAATADVN

SEQ ID NO: 5003 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKPDRNNNSEFSWTGATKYHLNGRDSLVNPGPAMASHRDDDEKFFPQSGVLIFGKQSAGANNVEIESVMITDEEEIRTTNPVATEQYGSVSTNLQAGNAQAATADVN

SEQ ID NO: 5004 - protein, 334 aa, Artificial Sequence; identical to SEQ ID NO: 4615
  Synthetic

SEQ ID NO: 5005 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGTNTLSRLLFSQAGASDIRDQSRNWLPGPCYRQQRVSKTADGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5006 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQRGNRQAATADVN

SEQ ID NO: 5007 - protein, 334 aa, Artificial Sequence; identical to SEQ ID NO: 1255
  Synthetic

SEQ ID NO: 5008 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKTDGENNNSDFSWTGATKYHLNGRDSLVNPGPAMASHKDDEEKFFPQSGVLIFGKQGASTTNAAIEDVMITDEEEIRTTNPVATEQYGSVSTNLQAGNAQAATADVN

SEQ ID NO: 5009 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGNHTLSALRFSQAGASDIRDQSRNWLPGPCYRQQRVSTKPSDNNNSDFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5010 - protein, 334 aa, Artificial Sequence; identical to SEQ ID NO: 853
  Synthetic

SEQ ID NO: 5011 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSDFSWTGATKYHLNGRDSLVNPGPAMASHKDDEEKFFPQSGVLIFGKEGAGKTDVAIGRVMITDEEEIRTTNPVATEQYGSVSTNLQAGNAQAATADVN

SEQ ID NO: 5012 - protein, 334 aa, Artificial Sequence; identical to SEQ ID NO: 613
  Synthetic

SEQ ID NO: 5013 - protein, 334 aa, Artificial Sequence; identical to SEQ ID NO: 2476
  Synthetic

SEQ ID NO: 5014 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTDRFFPQSGVLIFGKQDSRATNVDIESVMITDEEEIRTTNPVATEQYGSVSTNLQAGNAQAATADVN

SEQ ID NO: 5015 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSDFSWTGATTYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5016 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQPSQNNNSNFSWTGATKYHLNGRDSLVNPGPAMASHEDDTGRFFPQSGVLIFGKQGSEKTNVDIEKVMITDEEEIRTTNPVATEQYGSVSTNLQRGNRQAATADVN

SEQ ID NO: 5017 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5018 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTDGGHVTMSALRFSQAGASDIRDQSRNWLPGPCYRQQRVSKTSADNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 5019 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEDGKGANVDIGEVMITDEEEIRTTNPVATEQYGSVSTNLQAGNAQAATADVN

SEQ ID NO: 5020 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGKFFPQSGVLIFGKENSAGGDVEIEKVMITDEEEIRTTNPVATEQYGSVSTNLQAGNAQAATADVN

SEQ ID NO: 5021 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGGGANDTDIEGVMITDEEEIRTTNPVATEQYGSVSTNLQAGNAQAATADVN

SEQ ID NO: 5022 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 5023 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTADHNNNSDFSWTGATKYHLNGRDSLVNPGPAMASHEDDADKFFPQSGVLIFGKQSADAGNVAIESVMITDEEEIRTTNPVATEQYGSVSTNLQAGNAQAATADVN

SEQ ID NO: 5024 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSTTADGNNNSDFSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5025 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHKDDDDRFFPQSGVLIFGKQDTAGNNVDYERVMITDEEEIRTTNPVATEQYGSVSTNLQAGNAQAATADVN

SEQ ID NO: 5026 - protein, 334 aa, Artificial Sequence; identical to SEQ ID NO: 1419
  Synthetic

SEQ ID NO: 5027 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTSADNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5028 - protein, 334 aa, Artificial Sequence; identical to SEQ ID NO: 2107
  Synthetic

SEQ ID NO: 5029 - protein, 334 aa, Artificial Sequence; identical to SEQ ID NO: 1564
  Synthetic

SEQ ID NO: 5030 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHGDDTDRFFPQSGVLIFGKQDGGKTNVDYEQVMITDEEEIRTTNPVATEQYGSVSTNLQAGNAQAATADVN

SEQ ID NO: 5031 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 5032 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGHKTPSNLGFSQAGASDIRDQSRNWLPGPCYRQQRVSKTSADNNNSNFSWTGATKYHLNGRDSLVNPGPAMASHKDDNDRFFPQSGVLIFGKQGSEKTNVDIEKVMITDEEEIRTTNPVATEQYGSVSTNLQRGNRQAATADVN

SEQ ID NO: 5033 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLRFSQAGASDIRDQSRNWLPGPCYRQQRVSKTSADNNNSEYSWTGATKYHLNGRDSLVNPGPAMASHKDDEEKFFPQSGVLIFGKQGATESDVDFDQVMITDEEEIRTTNPVATEQYGSVSTNLQAGNAQAATADVN

SEQ ID NO: 5034 - protein, 334 aa, Artificial Sequence; identical to SEQ ID NO: 880
  Synthetic

SEQ ID NO: 5035 - protein, 334 aa, Artificial Sequence; identical to SEQ ID NO: 78
  Synthetic

SEQ ID NO: 5036 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5037 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGHNTLSGLRFSQAGASDIRDQSRNWLPGPCYRQQRVSKTDGENNNSDFSWTGATKYHLNGRDSLVNPGPAMASHKDDEEKFFPQSGVLIFGKEGAKGGNVAIDQVMITDEEEIRTTNPVATEQYGSVSTNLQAGNAQAATADVN

SEQ ID NO: 5038 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRHGTAATKDVA

SEQ ID NO: 5039 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQARSNRAAFDVVH

SEQ ID NO: 5040 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALGFSQAGASDIRDQSRNWLPGPCYRQQRVSKTSADNNNSNFSWTGATTYHLNGRDSLVNPGPAMASHRDDEEKFFPQSGVLIFGKQDAEKNNVAIEEVMITDEEEIRTTNPVATEQYGSVSTNLQAGNAQAATADVN

SEQ ID NO: 5041 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAAGITTMSGLRFSQAGASDIRDQSRNWLPGPCYRQQRVSKQSSDNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5042 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNAGNATMSNLKFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 5043 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGKGRAATNDVQ

SEQ ID NO: 5044 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAEKFFPQSGVLIFGKQGAKGDNAEYDQVMITDEEEIRTTNPVATEQYGSVSTNLQAGNAQAATADVN

SEQ ID NO: 5045 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5046 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGRLTHSQLEFSQAGASDIRDQSRNWLPGPCYRQQRVSKQPNDNNNSEFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5047 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5048 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAESGTATTSRLRFSQAGASDIRDQSRNWLPGPCYRQQRVSKTSADNNNSEYSWTGATKYHLNGRDSLVNPGPAMASHKDDEEKFFPQSGVLIFGKEGTGTANAEVGEVMITDEEEIRTTNPVATEQYGSVSTNLQAGNAQAATADVN

SEQ ID NO: 5049 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRSGHDTLSNLLFSQAGASDIRDQSRNWLPGPCYRQQRVSKTAGRNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5050 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQPGDNNNSNFSWTGATKYHLNGRDSLVNPGPAMASHGDDAGKFFPQSGVLIFGKQGSEKTNVDIEKVMITDEEEIRTTNPVATEQYGSVSTNLQAGNAQAATADVN

SEQ ID NO: 5051 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSEFSWTGATTYHLNGRDSLVNPGPAMASHKDDDDKFFPQSGVLIFGKQGTKRDDVAIDEVMITDEEEIRTTNPVATEQYGSVSTNLQAGNAQAATADVN

SEQ ID NO: 5052 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRHAAAANDAVP

SEQ ID NO: 5053 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENSTTGNIEIDRVMITDEEEIRTTNPVATEQYGSVSTNLQAGNAQAATADVN

SEQ ID NO: 5054 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5055 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQSAKAANAAIDEVMITDEEEIRTTNPVATEQYGSVSTNLQAGNAQAATADVN

SEQ ID NO: 5056 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDTAGTDVAIDGVMITDEEEIRTTNPVATEQYGSVSTNLQAGNAQAATADVN

SEQ ID NO: 5057 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRAGTITTSRLSFSQAGASDIRDQSRNWLPGPCYRQQRVSKKDDGNNNSNFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5058 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGHNTHSTLMFSQAGASDIRDQSRNWLPGPCYRQQRVSKTHGDNNNSNFSWTGATTYHLNGRDSLVNPGPAMASHRDDEDRFFPQSGVLIFGKQGSEKTNVDIDKVMITDEEEIRTTNPVATEQYGSVSTNLQAGNAQAATADVN

SEQ ID NO: 5059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 5060 - protein, 334 aa, Artificial Sequence; identical to SEQ ID NO: 219
  Synthetic

SEQ ID NO: 5061 - protein, 334 aa, Artificial Sequence; identical to SEQ ID NO: 1841
  Synthetic

SEQ ID NO: 5062 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLKFSQAGASDIRDQSRNWLPGPCYRQQRVSTTAGDNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5063 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKEDGDGANVAIDRVMITDEEEIRTTNPVATEQYGSVSTNLQAGNAQAATADVN

SEQ ID NO: 5064 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNKTPSPLNFSQAGASDIRDQSRNWLPGPCYRQQRVSTQPTENNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5065 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKQASDNNNSEFSWTGATKYHLNGRDSLVNPGPAMASHKDDEEKFFPQSGVLIFGKEGAGGNNVAIDGVMITDEEEIRTTNPVATEQYGSVSTNLQAGNAQAATADVN

SEQ ID NO: 5066 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5067 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 5068 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5069 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRTGLATLSGLKFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5070 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGLQTTSELRFSQAGASDIRDQSRNWLPGPCYRQQRVSKPPNGNNNSEFSWTGATTYHLNGRDSLVNPGPAMASHKDDEGRFFPQSGVLIFGKEGAGKTDVAIGRVMITDEEEIRTTNPVATEQYGSVSTNLQAGNAQAATADVN

SEQ ID NO: 5071 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTSADNNNSEYSWTGATKYHLNGRDSLVNPGPAMASHKDDAEKFFPQSGVLIFGKQNSKATDAEIEDVMITDEEEIRTTNPVATEQYGSVSTNLQAGNAQAATADVN

SEQ ID NO: 5072 - protein, 334 aa, Artificial Sequence; identical to SEQ ID NO: 4613
  Synthetic

SEQ ID NO: 5073 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTGAATHTVE

SEQ ID NO: 5074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPNTQAAAHGVH

SEQ ID NO: 5075 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQSSTAANTEFDEVMITDEEEIRTTNPVATEQYGSVSTNLQAGNAQAATADVN

SEQ ID NO: 5076 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKQGSEKTNVDIEKVMITDEEEIRTTNPVATEQYGSVSTNLQAGNAQAATADVN

SEQ ID NO: 5077 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANSGSITLSHLRFSQAGASDIRDQSRNWLPGPCYRQQRVSKTSADNNNSNFSWTGATKYHLNGRDSLVNPGPAMASHRDDEDKFFPQSGVLIFGKEGTAKSNVEYEKVMITDEEEIRTTNPVATEQYGSVSTNLQAGNAQAATADVN

SEQ ID NO: 5078 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSTQSTGNNNSDFSWTGATKYHLNGRDSLVNPGPAMASHKDDDDRFFPQSGVLIFGKQGAGRADIDIESVMITDEEEIRTTNPVATEQYGSVSTNLQAGNAQAATADVN

SEQ ID NO: 5079 - protein, 334 aa, Artificial Sequence; identical to SEQ ID NO: 1004
  Synthetic

SEQ ID NO: 5080 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESAGRSDTAIDEVMITDEEEIRTTNPVATEQYGSVSTNLQRGNRQAATADVN

SEQ ID NO: 5081 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTYNDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5082 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQPNDNNNSEFSWTGATTYHLNGRDSLVNPGPAMASHKDDADRFFPQSGVLIFGKQDSGRANVDFEKVMITDEEEIRTTNPVATEQYGSVSTNLQAGNAQAATADVN

SEQ ID NO: 5083 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRNTTSSLGFSQAGASDIRDQSRNWLPGPCYRQQRVSKTHGDNNNSNFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5084 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGIPTNSHLRFSQAGASDIRDQSRNWLPGPCYRQQRVSKQDTDNNNSDFSWTGATKYHLNGRDSLVNPGPAMASHGDDDGKFFPQSGVLIFGKQGGGGTDVEIEKVMITDEEEIRTTNPVATEQYGSVSTNLQAGNAQAATADVN

SEQ ID NO: 5085 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 5086 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGRKNAAAFQNVE

SEQ ID NO: 5087 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5088 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENASKNNAEYDRVMITDEEEIRTTNPVATEQYGSVSTNLQAGNAQAATADVN

SEQ ID NO: 5089 - protein, 334 aa, Artificial Sequence; identical to SEQ ID NO: 2285
  Synthetic

SEQ ID NO: 5090 - protein, 334 aa, Artificial Sequence; identical to SEQ ID NO: 561
  Synthetic

SEQ ID NO: 5091 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPAGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5092 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPRARAADNIVD

SEQ ID NO: 5093 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5094 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDGSRTNVEIGEVMITDEEEIRTTNPVATEQYGSVSTNLQAGNAQAATADVN

SEQ ID NO: 5095 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARAQAAISGVQ

SEQ ID NO: 5096 - protein, 334 aa, Artificial Sequence; identical to SEQ ID NO: 941
  Synthetic

SEQ ID NO: 5097 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQSGGATNVDIDGVMITDEEEIRTTNPVATEQYGSVSTNLQAGNAQAATADVN

SEQ ID NO: 5098 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKKDTDNNNSEFSWTGATTYHLNGRDSLVNPGPAMASHKDDDDKFFPQSGVLIFGKENSDKANVEVDDVMITDEEEIRTTNPVATEQYGSVSTNLQAGNAQAATADVN

SEQ ID NO: 5099 - protein, 334 aa, Artificial Sequence; identical to SEQ ID NO: 679
  Synthetic

SEQ ID NO: 5100 - protein, 334 aa, Artificial Sequence; identical to SEQ ID NO: 419
  Synthetic

SEQ ID NO: 5101 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGSLTLSRLMFSQAGASDIRDQSRNWLPGPCYRQQRVSKTDGENNNSDFSWTGATKYHLNGRDSLVNPGPAMASHKDDEEKFFPQSGVLIFGKESSDRNNVDIEQVMITDEEEIRTTNPVATEQYGSVSTNLQAGNAQAATADVN

SEQ ID NO: 5102 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARRDAAANRDVT

SEQ ID NO: 5103 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKAADNNNSNFSWTGATKYHLNGRDSLVNPGPAMASHKDDEEKFFPQSGVLIFGKESAKKTDVEIENVMITDEEEIRTTNPVATEQYGSVSTNLQAGNAQAATADVN

SEQ ID NO: 5104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQADKTAAAVKGVQ

SEQ ID NO: 5105 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRQAGAATHEVA

SEQ ID NO: 5106 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGSMTLSHLRFSQAGASDIRDQSRNWLPGPCYRQQRVSKVSADNNNSEFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 5107 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKEDGKGNNVAFEKVMITDEEEIRTTNPVATEQYGSVSTNLQAGNAQAATADVN

SEQ ID NO: 5109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDKQTSAAFRGVQ

SEQ ID NO: 5110 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRNNAATTNVT

SEQ ID NO: 5111 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELMFSQAGASDIRDQSRNWLPGPCYRQQRVSKTDGENNNSDFSWTGATKYHLNGRDSLVNPGPAMASHKDDEEKFFPQSGVLIFGKQGAGKNNAAIGQVMITDEEEIRTTNPVATEQYGSVSTNLQAGNAQAATADVN

SEQ ID NO: 5112 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHRDDDDKFFPQSGVLIFGKQGSEKTNVDIEKVMITDEEEIRTTNPVATEQYGSVSTNLQTHRDTAAFRMVT

SEQ ID NO: 5113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGAAGTNAAIERVMITDEEEIRTTNPVATEQYGSVSTNLQAGNAQAATADVN

SEQ ID NO: 5114 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGIVTKSGLKFSQAGASDIRDQSRNWLPGPCYRQQRVSKQSDRNNNSDFSWTGATKYHLNGRDSLVNPGPAMASHKDDDDRFFPQSGVLIFGKQGSEKTNVDIEKVMITDEEEIRTTNPVATEQYGSVSTNLQGQKDRAASTDVH

SEQ ID NO: 5115 - protein, 334 aa, Artificial Sequence; identical to SEQ ID NO: 2716
  Synthetic

SEQ ID NO: 5116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDNDKFFPQSGVLIFGKESSGANNVEVDGVMITDEEEIRTTNPVATEQYGSVSTNLQAGNAQAATADVN

SEQ ID NO: 5117 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSGGRVTPSGLHFSQAGASDIRDQSRNWLPGPCYRQQRVSKTPAENNNSNFSWTGATTYHLNGRDSLVNPGPAMASHRDDTGRFFPQSGVLIFGKEGAGKSNVEIDNVMITDEEEIRTTNPVATEQYGSVSTNLQAGNAQAATADVN

SEQ ID NO: 5118 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTASSAAAYAAVN

SEQ ID NO: 5119 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQDAAGSNAAVDKVMITDEEEIRTTNPVATEQYGSVSTNLQAGNAQAATADVN

SEQ ID NO: 5120 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5121 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQERRTHAATTEVN

SEQ ID NO: 5122 - protein, 334 aa, Artificial Sequence; identical to SEQ ID NO: 1011
  Synthetic

SEQ ID NO: 5123 - protein, 334 aa, Artificial Sequence; identical to SEQ ID NO: 359
  Synthetic

SEQ ID NO: 5124 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGRAGAAVRDVH

SEQ ID NO: 5125 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDEAGRQTTSNLLFSQAGASDIRDQSRNWLPGPCYRQQRVSKTSADNNNSNFSWTGATKYHLNGRDSLVNPGPAMASHRDDEDKFFPQSGVLIFGKQGASETNVEIDKVMITDEEEIRTTNPVATEQYGSVSTNLQAGNAQAATADVN

SEQ ID NO: 5126 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAGKANTDVENVMITDEEEIRTTNPVATEQYGSVSTNLQAGNAQAATADVN

SEQ ID NO: 5127 - protein, 334 aa, Artificial Sequence; identical to SEQ ID NO: 463
  Synthetic

SEQ ID NO: 5128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENGGGSDAEIDDVMITDEEEIRTTNPVATEQYGSVSTNLQAGNAQAATADVN

SEQ ID NO: 5129 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGPTTTSTLMFSQAGASDIRDQSRNWLPGPCYRQQRVSKTSADNNNSDFSWTGATKYHLNGRDSLVNPGPAMASHKDDDDRFFPQSGVLIFGKQGAGASNVDFDRVMITDEEEIRTTNPVATEQYGSVSTNLQRGNRQAATADVN

SEQ ID NO: 5130 - protein, 334 aa, Artificial Sequence; identical to SEQ ID NO: 394
  Synthetic

SEQ ID NO: 5131 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKESTARNNADVEQVMITDEEEIRTTNPVATEQYGSVSTNLQAGNAQAATADVN

SEQ ID NO: 5132 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKENSGKANVDIEQVMITDEEEIRTTNPVATEQYGSVSTNLQAGNAQAATADVN

SEQ ID NO: 5133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGATGSDVAIEHVMITDEEEIRTTNPVATEQYGSVSTNLQAGNAQAATADVN

SEQ ID NO: 5134 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAKGNNVEVGQVMITDEEEIRTTNPVATEQYGSVSTNLQAGNAQAATADVN

SEQ ID NO: 5135 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTTEANVDIGQVMITDEEEIRTTNPVATEQYGSVSTNLQAGNAQAATADVN

SEQ ID NO: 5136 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDGTATNIEIEEVMITDEEEIRTTNPVATEQYGSVSTNLQAGNAQAATADVN

SEQ ID NO: 5137 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATKYHLNGRDSLVNPGPAMASHKDDDDRFFPQSGVLIFGKQDTRTGNADIGGVMITDEEEIRTTNPVATEQYGSVSTNLQAGNRQAATADVN

SEQ ID NO: 5138 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5139 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 5140 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAKNTEAATGDVN

SEQ ID NO: 5141 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5142 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRGNAATADVN

SEQ ID NO: 5143 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHRDDDDKFFPQSGVLIFGKEGTGANNAEIGEVMITDEEEIRTTNPVATEQYGSVSTNLQAGNAQAATADVN

SEQ ID NO: 5144 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQDRRSAAAYTTVQ

SEQ ID NO: 5145 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRAAAASRDVN

SEQ ID NO: 5146 - protein, 334 aa, Artificial Sequence; identical to SEQ ID NO: 2270
  Synthetic

SEQ ID NO: 5147 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGNTQAAVRMVT

SEQ ID NO: 5148 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHGDDNDRFFPQSGVLIFGKQGTGASNVEVENVMITDEEEIRTTNPVATEQYGSVSTNLQAGNAQAATADVN

SEQ ID NO: 5149 - protein, 334 aa, Artificial Sequence; identical to SEQ ID NO: 349
  Synthetic

SEQ ID NO: 5150 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDGRFFPQSGVLIFGKESAGANNAEIGEVMITDEEEIRTTNPVATEQYGSVSTNLQAGNAQAATADVN

SEQ ID NO: 5151 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQGAGASNVDFDRVMITDEEEIRTTNPVATEQYGSVSTNLQRGNRQAATADVN

SEQ ID NO: 5152 - protein, 334 aa, Artificial Sequence; identical to SEQ ID NO: 829
  Synthetic

SEQ ID NO: 5153 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQSADAGNVAIESVMITDEEEIRTTNPVATEQYGSVSTNLQAGNAQAATADVN

SEQ ID NO: 5154 - protein, 334 aa, Artificial Sequence; identical to SEQ ID NO: 1626
  Synthetic

SEQ ID NO: 5155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDAEKFFPQSGVLIFGKQGANKANVAVEGVMITDEEEIRTTNPVATEQYGSVSTNLQAGNAQAATADVN

SEQ ID NO: 5156 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSTPPSQNNNSNFSWTGATTYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 5157 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5158 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSEYSWTGATKYHLNGRDSLVNPGPAMASHKDDAGKFFPQSGVLIFGKQGSEKTNVDIEKVMITDEEEIRTTNPVATEQYGSVSTNLQAGNAQAATADVN

SEQ ID NO: 5159 - protein, 334 aa, Artificial Sequence; identical to SEQ ID NO: 3726
  Synthetic

SEQ ID NO: 5160 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRRDQAANASVP

SEQ ID NO: 5161 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAASAGAAYNNVA

SEQ ID NO: 5162 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGNDTLSQLRFSQAGASDIRDQSRNWLPGPCYRQQRVSTTSNENNNSDFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5163 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKTDGENNNSDFSWTGATKYHLNGRDSLVNPGPAMASHKDDEEKFFPQSGVLIFGKQNSARSNVEIGQVMITDEEEIRTTNPVATEQYGSVSTNLQAGNAQAATADVN

SEQ ID NO: 5164 - protein, 334 aa, Artificial Sequence; identical to SEQ ID NO: 563
  Synthetic

SEQ ID NO: 5165 - protein, 334 aa, Artificial Sequence; identical to SEQ ID NO: 1325
  Synthetic

SEQ ID NO: 5166 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGGGEGNVEIDGVMITDEEEIRTTNPVATEQYGSVSTNLQAGNAQAATADVN

SEQ ID NO: 5167 - protein, 334 aa, Artificial Sequence; identical to SEQ ID NO: 658
  Synthetic

SEQ ID NO: 5168 - protein, 334 aa, Artificial Sequence; identical to SEQ ID NO: 1215
  Synthetic

SEQ ID NO: 5169 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 5170 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGTATDVDVDRVMITDEEEIRTTNPVATEQYGSVSTNLQAGNAQAATADVN

SEQ ID NO: 5171 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDGGLATKSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5172 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQDSTGNNIDIEQVMITDEEEIRTTNPVATEQYGSVSTNLQAGNAQAATADVN

SEQ ID NO: 5173 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSNSTQAAYHVVE

SEQ ID NO: 5174 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDAEKFFPQSGVLIFGKESAGRNNIEIGGVMITDEEEIRTTNPVATEQYGSVSTNLQAGNAQAATADVN

SEQ ID NO: 5175 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEDGATGNVDVDRVMITDEEEIRTTNPVATEQYGSVSTNLQAGNAQAATADVN

SEQ ID NO: 5176 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKEGAGGNDVDIERVMITDEEEIRTTNPVATEQYGSVSTNLQAGNAQAATADVN

SEQ ID NO: 5177 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNRAPAAISDVE

SEQ ID NO: 5178 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDNAAYRTVT

SEQ ID NO: 5179 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGGNGNNVEIESVMITDEEEIRTTNPVATEQYGSVSTNLQAGNAQAATADVN

SEQ ID NO: 5180 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSNKANVDVGEVMITDEEEIRTTNPVATEQYGSVSTNLQAGNAQAATADVN

SEQ ID NO: 5181 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDADRFFPQSGVLIFGKQGADATNTEVDSVMITDEEEIRTTNPVATEQYGSVSTNLQAGNAQAATADVN

SEQ ID NO: 5183 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTATQSTLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5184 - protein, 334 aa, Artificial Sequence; identical to SEQ ID NO: 664
  Synthetic

SEQ ID NO: 5185 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKEGGTEGDADIEKVMITDEEEIRTTNPVATEQYGSVSTNLQAGNAQAATADVN

SEQ ID NO: 5186 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGIDTKSRLVFSQAGASDIRDQSRNWLPGPCYRQQRVSKTSADNNNSEYSWTGATKYHLNGRDSLVNPGPAMASHKDDEEKFFPQSGVLIFGKQGAGKDDVDIGGVMITDEEEIRTTNPVATEQYGSVSTNLQAGNAQAATADVN

SEQ ID NO: 5187 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESGAAANVEVEQVMITDEEEIRTTNPVATEQYGSVSTNLQAGNAQAATADVN

SEQ ID NO: 5188 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKQSGKRANVEIDQVMITDEEEIRTTNPVATEQYGSVSTNLQAGNAQAATADVN

SEQ ID NO: 5189 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 5190 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKQGSEKTNVDIEKVMITDEEEIRTTNPVATEQYGSVSTNLQAGNAQAATADVN

SEQ ID NO: 5191 - protein, 334 aa, Artificial Sequence
  Synthetic
QTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 5192 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSRTDNVAIEHVMITDEEEIRTTNPVATEQYGSVSTNLQAGNAQAATADVN

SEQ ID NO: 5193 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGRFFPQSGVLIFGKEGADGANVAYDRVMITDEEEIRTTNPVATEQYGSVSTNLQAGNAQAATADVN

SEQ ID NO: 5194 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5195 - protein, 334 aa, Artificial Sequence; identical to SEQ ID NO: 4536
  Synthetic

SEQ ID NO: 5196 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDAGRGNVAYDHVMITDEEEIRTTNPVATEQYGSVSTNLQAGNAQAATADVN

SEQ ID NO: 5197 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKEDATKDNADIDKVMITDEEEIRTTNPVATEQYGSVSTNLQAGNAQAATADVN

SEQ ID NO: 5198 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAENNNSDFSWTGATKYHLNGRDSLVNPGPAMASHKDDEEKFFPQSGVLIFGKEGGTEGDIAIEDVMITDEEEIRTTNPVATEQYGSVSTNLQAGKAQAATADVN

SEQ ID NO: 5199 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYGDNNNSEFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5200 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKESTTEANVDIEKVMITDEEEIRTTNPVATEQYGSVSTNLQAGNAQAATADVN

SEQ ID NO: 5201 - protein, 334 aa, Artificial Sequence; identical to SEQ ID NO: 272
  Synthetic

SEQ ID NO: 5202 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKQSDRNNNSEFSWTGATKYHLNGRDSLVNPGPAMASHKDDEDKFFPQSGVLIFGKQGSNRADVEIEQVMITDEEEIRTTNPVATEQYGSVSTNLQAGNAQAATADVN

SEQ ID NO: 5203 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLGFSQAGASDIRDQSRNWLPGPCYRQQRVSKTPDGNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 5204 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTKTLSRLGFSQAGASDIRDQSRNWLPGPCYRQQRVSKTSADNNNSEYSWTGATTYHLNGRDSLVNPGPAMASHGDDDDKFFPQSGVLIFGKESAAKDNVEIGDVMITDEEEIRTTNPVATEQYGSVSTNLQAGNAQAATADVN

SEQ ID NO: 5205 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSGDNNNSDFSWTGATKYHLNGRDSLVNPGPAMASHKDDDEKFFPQSGVLIFGKQGGTATDVEFDKVMITDEEEIRTTNPVATEQYGSVSTNLQAGNAQAATADVN

SEQ ID NO: 5206 - protein, 334 aa, Artificial Sequence; identical to SEQ ID NO: 2212
  Synthetic

SEQ ID NO: 5207 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGATGSNVEYGSVMITDEEEIRTTNPVATEQYGSVSTNLQAGNAQAATADVN

SEQ ID NO: 5208 - protein, 334 aa, Artificial Sequence; identical to SEQ ID NO: 451
  Synthetic

SEQ ID NO: 5209 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5210 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTAESNIHIDGVMITDEEEIRTTNPVATEQYGSVSTNLQAGNAQAATADVN

SEQ ID NO: 5211 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEDAGRGDVDIGNVMITDEEEIRTTNPVATEQYGSVSTNLQAGNAQAATADVN

SEQ ID NO: 5212 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRRDPAADNMVT

SEQ ID NO: 5213 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSGRDNVAVDGVMITDEEEIRTTNPVATEQYGSVSTNLQAGNAQAATADVN

SEQ ID NO: 5214 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNKQNGAANHEVT

SEQ ID NO: 5215 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENTTGNDAEIGQVMITDEEEIRTTNPVATEQYGSVSTNLQAGNAQAATADVN

SEQ ID NO: 5216 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5217 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGATESDVDFDQVMITDEEEIRTTNPVATEQYGSVSTNLQAGNAQAATADVN

SEQ ID NO: 5218 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGITTHSDLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5219 - protein, 334 aa, Artificial Sequence; identical to SEQ ID NO: 930
  Synthetic

SEQ ID NO: 5220 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTPSHLSFSQAGASDIRDQSRNWLPGPCYRQQRVSKTYNDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5221 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGINTMSKLLFSQAGASDIRDQSRNWLPGPCYRQQRVSKTDGENNNSDFSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5222 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRNNAAARDVH

SEQ ID NO: 5223 - protein, 334 aa, Artificial Sequence; identical to SEQ ID NO: 191
  Synthetic

SEQ ID NO: 5224 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDNDKFFPQSGVLIFGKESAGANNVDIGGVMITDEEEIRTTNPVATEQYGSVSTNLQAGNAQAATADVN

SEQ ID NO: 5225 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5226 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEDATRSNVEIEGVMITDEEEIRTTNPVATEQYGSVSTNLQAGNAQAATADVN

SEQ ID NO: 5227 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATTYHLNGRDSLVNPGPAMASHKDDEEKFFPQSGVLIFGKQGSEKTNVDIEKVMITDEEEIRTTNPVATEQYGSVSTNLQGRHAAAANDAVP

SEQ ID NO: 5228 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGSKTTDVAIEDVMITDEEEIRTTNPVATEQYGSVSTNLQAGNAQAATADVN

SEQ ID NO: 5229 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5230 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQSASKNNIAIEEVMITDEEEIRTTNPVATEQYGSVSTNLQAGNAQAATADVN

SEQ ID NO: 5231 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKEGAGGTDIDIGHVMITDEEEIRTTNPVATEQYGSVSTNLQAGNAQAATADVN

SEQ ID NO: 5232 - protein, 334 aa, Artificial Sequence; identical to SEQ ID NO: 1087
  Synthetic

SEQ ID NO: 5233 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKEGAGGTDVEIDGVMITDEEEIRTTNPVATEQYGSVSTNLQAGNAQAATADVN

SEQ ID NO: 5234 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKEDAARTDVAIDKVMITDEEEIRTTNPVATEQYGSVSTNLQAGNAQAATADVN

SEQ ID NO: 5235 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGRHTLSKLGFSQAGASDIRDQSRNWLPGPCYRQQRVSKQSDRNNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 5236 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHRDDADKFFPQSGVLIFGKQGSEKTNVDIEKVMITDEEEIRTTNPVATEQYGSVSTNLQAGNAQAATADVN

SEQ ID NO: 5237 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGNTTKSGLSFSQAGASDIRDQSRNWLPGPCYRQQRVSKTDSHNNNSDFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKQNAEASNADIDRVMITDEEEIRTTNPVATEQYGSVSTNLQAGNAQAATADVN

SEQ ID NO: 5239 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQDHRARAAFGDVN

SEQ ID NO: 5240 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTQAATRVVD

SEQ ID NO: 5241 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARDGAATTVVH

SEQ ID NO: 5242 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATTYHLNGRDSLVNPGPAMASHKDDADRFFPQSGVLIFGKEGGTEGDIAIEDVMITDEEEIRTTNPVATEQYGSVSTNLQAGNAQAATADVN

SEQ ID NO: 5243 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5244 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKEGATRANIEIDDVMITDEEEIRTTNPVATEQYGSVSTNLQAGNAQAATADVN

SEQ ID NO: 5245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGASETNVEIDKVMITDEEEIRTTNPVATEQYGSVSTNLQAGNAQAATADVN

SEQ ID NO: 5246 - protein, 334 aa, Artificial Sequence; identical to SEQ ID NO: 2118
  Synthetic

SEQ ID NO: 5247 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGSLTQSHLGFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 5248 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGASESNIDIDGVMITDEEEIRTTNPVATEQYGSVSTNLQAGNAQAATADVN

SEQ ID NO: 5249 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGNQTQSALRFSQAGASDIRDQSRNWLPGPCYRQQRVSKKYTDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5250 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKENSNESNTDIDGVMITDEEEIRTTNPVATEQYGSVSTNLQAGNAQAATADVN

SEQ ID NO: 5251 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHKDDEGKFFPQSGVLIFGKQNSTATDAAIGDVMITDEEEIRTTNPVATEQYGSVSTNLQAGNAQAATADVN

SEQ ID NO: 5252 - protein, 334 aa, Artificial Sequence; identical to SEQ ID NO: 1839
  Synthetic

SEQ ID NO: 5253 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGRKTLSNLEFSQAGASDIRDQSRNWLPGPCYRQQRVSKTSGGNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5254 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDNEKFFPQSGVLIFGKENAAEGNIDIDRVMITDEEEIRTTNPVATEQYGSVSTNLQAGNAQAATADVN

SEQ ID NO: 5255 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEEKFFPQSGVLIFGKQNAAANNVEFEHVMITDEEEIRTTNPVATEQYGSVSTNLQAGNAQAATADVN

SEQ ID NO: 5256 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKQPNDNNNSEFSWTGATTYHLNGRDSLVNPGPAMASHKDDEDKFFPQSGVLIFGKEGTGKDNIAFEQVMITDEEEIRTTNPVATEQYGSVSTNLQAGNAQAATADVN

SEQ ID NO: 5257 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGSRKNNAEFGEVMITDEEEIRTTNPVATEQYGSVSTNLQAGNAQAATADVN

SEQ ID NO: 5258 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKQDAETSDVDVDRVMITDEEEIRTTNPVATEQYGSVSTNLQAGNAQAATADVN

SEQ ID NO: 5259 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQTGTMTTSRLRFSQAGASDIRDQSRNWLPGPCYRQQRVSKKDTDNNNSEFSWTGATTYHLNGRDSLVNPGPAMASHKDDDDKFFPQSGVLIFGKEGSEKNDVEFEQVMITDEEEIRTTNPVATEQYGSVSTNLQAGNAQAATADVN

SEQ ID NO: 5260 - protein, 334 aa, Artificial Sequence; identical to SEQ ID NO: 2872
  Synthetic

SEQ ID NO: 5261 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGSDTAATRDVA

SEQ ID NO: 5262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAGTANVDFGGVMITDEEEIRTTNPVATEQYGSVSTNLQAGNAQAATADVN

SEQ ID NO: 5263 - protein, 334 aa, Artificial Sequence; identical to SEQ ID NO: 942
  Synthetic

SEQ ID NO: 5264 - protein, 334 aa, Artificial Sequence; identical to SEQ ID NO: 421
  Synthetic

SEQ ID NO: 5265 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNMTTSALRFSQAGASDIRDQSRNWLPGPCYRQQRVSKTDGENNNSDFSWTGATKYHLNGRDSLVNPGPAMASHKDDEEKFFPQSGVLIFGKEGAAADNIDIGQVMITDEEEIRTTNPVATEQYGSVSTNLQAGNAQAATADVN

SEQ ID NO: 5266 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGGNNTEIEGVMITDEEEIRTTNPVATEQYGSVSTNLQAGNAQAATADVN

SEQ ID NO: 5267 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQSAEGGNVDIDGVMITDEEEIRTTNPVATEQYGSVSTNLQAGNAQAATADVN

SEQ ID NO: 5268 - protein, 334 aa, Artificial Sequence; identical to SEQ ID NO: 60
  Synthetic

SEQ ID NO: 5269 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQADRTAAAAHDVH

SEQ ID NO: 5270 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEDKFFPQSGVLIFGKEGTGRANVAIEGVMITDEEEIRTTNPVATEQYGSVSTNLQAGNAQAATADVN

SEQ ID NO: 5271 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRDEAADRTVN

SEQ ID NO: 5272 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQDAGESNVAFEQVMITDEEEIRTTNPVATEQYGSVSTNLQAGNAQAATADVN

SEQ ID NO: 5273 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDAEKFFPQSGVLIFGKEGSAKADADIGDVMITDEEEIRTTNPVATEQYGSVSTNLQAGNAQAATADVN

SEQ ID NO: 5274 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEDSRKSNADIEGVMITDEEEIRTTNPVATEQYGSVSTNLQAGNAQAATADVN

SEQ ID NO: 5275 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPIGTTTQSRLQFSQAGASDIRDQSRNWLPGPCYRQQRVSKTSADNNNSEFSWTGATKYHLNGRDSLVNPGPAMASHRDDDGKFFPQSGVLIFGKQGATESDVDFDQVMITDEEEIRTTNPVATEQYGSVSTNLQAGNAQAATADVN

SEQ ID NO: 5276 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5277 - protein, 334 aa, Artificial Sequence; identical to SEQ ID NO: 1517
  Synthetic

SEQ ID NO: 5278 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRTTAAFAEVT

SEQ ID NO: 5279 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKENSRGNDIEFEDVMITDEEEIRTTNPVATEQYGSVSTNLQAGNAQAATADVN

SEQ ID NO: 5280 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGSVTPSGLSFSQAGASDIRDQSRNWLPGPCYRQQRVSKQPGDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5281 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLIFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5282 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDRFFPQSGVLIFGKENAAATNVAIEGVMITDEEEIRTTNPVATEQYGSVSTNLQAGNAQAATADVN

SEQ ID NO: 5283 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5284 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARGGHPTLSQLKFSQAGASDIRDQSRNWLPGPCYRQQRVSKTSDGNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5285 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHRDDNGKFFPQSGVLIFGKQGSEKTNVDIEKVMITDEEEIRTTNPVATEQYGSVSTNLQAGNAQAATADVN

SEQ ID NO: 5286 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGLDTLSTLGFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5287 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5288 - protein, 334 aa, Artificial Sequence; identical to SEQ ID NO: 610
  Synthetic

SEQ ID NO: 5289 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5290 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGTGASNVEVENVMITDEEEIRTTNPVATEQYGSVSTNLQAGNAQAATADVN

SEQ ID NO: 5291 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGSPTTSRLGFSQAGASDIRDQSRNWLPGPCYRQQRVSKTSADNNNSNFSWTGATKYHLNGRDSLVNPGPAMASHRDDEDKFFPQSGVLIFGKQSAKAANAAIDEVMITDEEEIRTTNPVATEQYGSVSTNLQAGNAQAATADVN

SEQ ID NO: 5292 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPSGLLTLSGLKFSQAGASDIRDQSRNWLPGPCYRQQRVSTTPADNNNSDFSWTGATKYHLNGRDSLVNPGPAMASHKDDDEKFFPQSGVLIFGKENSKAGDADIGEVMITDEEEIRTTNPVATEQYGSVSTNLQAGNAQAATADVN

SEQ ID NO: 5293 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLGFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5294 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSADNNNSDFSWTGATKYHLNGRDSLVNPGPAMASHKDDADKFFPQSGVLIFGKQNAAENDVDIGEVMITDEEEIRTTNPVATEQYGSVSTNLQAGNAQAATADVN

SEQ ID NO: 5295 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDAKGTNIDFDGVMITDEEEIRTTNPVATEQYGSVSTNLQAGNAQAATADVN

SEQ ID NO: 5296 - protein, 334 aa, Artificial Sequence; identical to SEQ ID NO: 3665
  Synthetic

SEQ ID NO: 5297 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGIDTKSRLVFSQAGASDIRDQSRNWLPGPCYRQQRVSTTPGGNNNSNFSWTGATKYHLNGRDSLVNPGPAMASHKDDDDKFFPQSGVLIFGKESGGGNNIAIDQVMITDEEEIRTTNPVATEQYGSVSTNLQAGNAQAATADVN

SEQ ID NO: 5298 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRAGTLTKSALSFSQAGASDIRDQSRNWLPGPCYRQQRVSKQASDNNNSEFSWTGATKYHLNGRDSLVNPGPAMASHKDDEEKFFPQSGVLIFGKENTGEANVDIGKVMITDEEEIRTTNPVATEQYGSVSTNLQAGNAQAATADVN

SEQ ID NO: 5299 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKTAADNNNSDFSWTGATKYHLNGRDSLVNPGPAMASHKDDDGKFFPQSGVLIFGKQGGTKNNVAIDEVMITDEEEIRTTNPVATEQYGSVSTNLQAGNAQAATADVN

SEQ ID NO: 5300 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQRGNRQAATADVN

SEQ ID NO: 5301 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEGRFFPQSGVLIFGKQGTGASNVEVENVMITDEEEIRTTNPVATEQYGSVSTNLQAGNAQAATADVN

SEQ ID NO: 5302 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSDGNNNSDFSWTGATKYHLNGRDSLVNPGPAMASHRDDTDRFFPQSGVLIFGKQGAEANNVAVEQVMITDEEEIRTTNPVATEQYGSVSTNLQAGNAQAATADVN

SEQ ID NO: 5303 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSTTPADNNNSDFSWTGATKYHLNGRDSLVNPGPAMASHKDDEEKFFPQSGVLIFGKENSGKANVDIEQVMITDEEEIRTTNPVATEQYGSVSTNLQAGNAQAATADVN

SEQ ID NO: 5304 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5305 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRGTAAVTEVT

SEQ ID NO: 5306 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKPANGNNNSEFSWTGATKYHLNGRDSLVNPGPAMASHKDDDDRFFPQSGVLIFGKEGANGGNADIEDVMITDEEEIRTTNPVATEQYGSVSTNLQAGNAQAATADVN

SEQ ID NO: 5307 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSNFSWTGATKYHLNGRDSLVNPGPAMASHEDDADKFFPQSGVLIFGKQGGGATDVEIGNVMITDEEEIRTTNPVATEQYGSVSTNLQAGNAQAATADVN

SEQ ID NO: 5308 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 5309 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRGGHTTPSELRFSQAGASDIRDQSRNWLPGPCYRQQRVSKTPNGNNNRDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 5310 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEYSWTGATKYHLNGRDSLVNPGPAMASHKDDEEKFFPQSGVLIFGKQGSEKTNVDIEKVMITDEEEIRTTNPVATEQYGSVSTNLQRPRDGAASNVVA

SEQ ID NO: 5311 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGNMTMSALLFSQAGASDIRDQSRNWLPGPCYRQQRVSTQPARNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5312 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5313 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDPGGINTLSPLKFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5314 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKQSSGKSNIAIEGVMITDEEEIRTTNPVATEQYGSVSTNLQAGNAQAATADVN

SEQ ID NO: 5315 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSKQASDNNNSEFSWTGATKYHLNGRDSLVNPGPAMASHKDDEEKFFPQSGVLIFGKEGAARSDVDIGSVMITDEEEIRTTNPVATEQYGSVSTNLQAGNAQAATADVN

SEQ ID NO: 5316 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGEGNNVEVDRVMITDEEEIRTTNPVATEQYGSVSTNLQAGNAQAATADVN

SEQ ID NO: 5317 - protein, 334 aa, Artificial Sequence; identical to SEQ ID NO: 1773
  Synthetic

SEQ ID NO: 5318 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSDTKSKLQFSQAGASDIRDQSRNWLPGPCYRQQRVSKTDNHNNNSDFSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 5319 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLIFSQAGASDIRDQSRNWLPGPCYRQQRVSKTSADNNNSEYSWTGATKYHLNGRDSLVNPGPAMASHKDDEEKFFPQSGVLIFGKQSAKAANAAIDEVMITDEEEIRTTNPVATEQYGSVSTNLQAGNAQAATADVN

SEQ ID NO: 5320 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTAETNIDIEKVMITDEEEIRTTNPVATEQYGSVSTNLQAGNAQAATADVN

SEQ ID NO: 5321 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSARGTNADIDEVMITDEEEIRTTNPVATEQYGSVSTNLQAGNAQAATADVN

SEQ ID NO: 5322 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDTDNNNSDFSWPGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 5323 - protein, 334 aa, Artificial Sequence; identical to SEQ ID NO: 1819
  Synthetic

SEQ ID NO: 5324 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTDGENNNSDFSWTGATKYHLNGRDSLVNPGPAMASHKDDEEKFFPQSGVLIFGKQSSSGNNIEIEDVMITDEEEIRTTNPVATEQYGSVSTNLQAGNAQAATADVN

SEQ ID NO: 5325 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTGNNNSNFSWTGATKYHLNGRDSLVNPGPAMASHEDDAGRFFPQSGVLIFGKQGSEKTNVDIEKVMITDEEEIRTTNPVATEQYGSVSTNLQAGNAQAATADVN

SEQ ID NO: 5326 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADKFFPQSGVLIFGKEGAAGANIAIGDVMITDEEEIRTTNPVATEQYGSVSTNLQAGNAQAATADVN

SEQ ID NO: 5327 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQPTGNNNSEFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 5328 - protein, 334 aa, Artificial Sequence; identical to SEQ ID NO: 384
  Synthetic

SEQ ID NO: 5329 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHGDDDDKFFPQSGVLIFGKEGANGGNADIEDVMITDEEEIRTTNPVATEQYGSVSTNLQAGNAQAATADVN

SEQ ID NO: 5330 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIQTMSQLRFSQAGASDIRDQSRNWLPGPCYRQQRVSKKPDQNNNSEFSWTGATKYHLNGRDSLVNPGPAMASHRDDEEKFFPQSGVLIFGKQGSEKTNVDIEKVMITDEEEIRTTNPVATEQYGSVSTNLQAGNAQAATADVN

SEQ ID NO: 5331 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGLNTLSDLRFSQAGASDIRDQSRNWLPGPCYRQQRVSKQSGQNNNSDFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 5332 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSTGTNTDIGQVMITDEEEIRTTNPVATEQYGSVSTNLQAGNAQAATADVN

SEQ ID NO: 5333 - protein, 334 aa, Artificial Sequence; identical to SEQ ID NO: 2756
  Synthetic

SEQ ID NO: 5334 - protein, 334 aa, Artificial Sequence; identical to SEQ ID NO: 1380
  Synthetic

SEQ ID NO: 5335 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEAGSLTKSQLRFSQAGASDIRDQSRNWLPGPCYRQQRVSKTDDGNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5336 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAKSGAAYANVN

SEQ ID NO: 5337 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKEGAGANDVAVEHVMITDEEEIRTTNPVATEQYGSVSTNLQAGNAQAATADVN

SEQ ID NO: 5338 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQSAAGADVAIDSVMITDEEEIRTTNPVATEQYGSVSTNLQAGNAQAATADVN

SEQ ID NO: 5339 - protein, 334 aa, Artificial Sequence; identical to SEQ ID NO: 1000
  Synthetic

SEQ ID NO: 5340 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSAGRVTLSALRFSQAGASDIRDQSRNWLPGPCYRQQRVSKTSADNNNSEYSWTGATKYHLNGRDSLVNPGPAMASHKDDDERFFPQSGVLIFGKEGTRKNNVDIEQVMITDEEEIRTTNPVATEQYGSVSTNLQAGNAQAATADVN

SEQ ID NO: 5341 - protein, 334 aa, Artificial Sequence; identical to SEQ ID NO: 944
  Synthetic

SEQ ID NO: 5342 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGATAADVEIDGVMITDEEEIRTTNPVATEQYGSVSTNLQAGNAQAATADVN

SEQ ID NO: 5343 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5344 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDNDKFFPQSGVLIFGKQGAGKTNIAYGNVMITDEEEIRTTNPVATEQYGSVSTNLQAGNAQAATADVN

SEQ ID NO: 5345 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGAGADNVDFDGVMITDEEEIRTTNPVATEQYGSVSTNLQAGNAQAATADVN

SEQ ID NO: 5346 - protein, 334 aa, Artificial Sequence; identical to SEQ ID NO: 878
  Synthetic

SEQ ID NO: 5347 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHANAADGMVA

SEQ ID NO: 5348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGTGASNVEVENVMITDEEEIRTTNPVATEQYGSVSTNLQAGNAQAATADVN

SEQ ID NO: 5349 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPTHNNNSNFSWTGATKYHLNGRDSLVNPGPAMASHRDDDDKFFPQSGVLIFGKEGAGGNNVDFGEVMITDEEEIRTTNPVATEQYGSVSTNLQAGNAQAATADVN

SEQ ID NO: 5350 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEDSAKGNTDIDNVMITDEEEIRTTNPVATEQYGSVSTNLQAGNAQAATADVN

SEQ ID NO: 5351 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDNGRFFPQSGVLIFGKQDAGKSNADIDRVMITDEEEIRTTNPVATEQYGSVSTNLQAGNAQAATADVN

SEQ ID NO: 5352 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATKDGAASRAVQ

SEQ ID NO: 5353 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDTGRFFPQSGVLIFGKQGSEKTNVDIEKVMITDEEEIRTTNPVATEQYGSVSTNLQAGNAQAATADVN

SEQ ID NO: 5354 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGGTEGDADIDKVMITDEEEIRTTNPVATEQYGSVSTNLQAGNAQAATADVN

SEQ ID NO: 5355 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDAEKFFPQSGVLIFGKEGAGTNDIDIEKVMITDEEEIRTTNPVATEQYGSVSTNLQAGNAQAATADVN

SEQ ID NO: 5356 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHRDDEDKFFPQSGVLIFGKESTGGNDVEYDQVMITDEEEIRTTNPVATEQYGSVSTNLQAGNAQAATADVN

SEQ ID NO: 5357 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSDRNNNSDFSWTGATTYHLNGRDSLVNPGPAMASHGDDEDKFFPQSGVLIFGKEGTRKNNVDIEQVMITDEEEIRTTNPVATEQYGSVSTNLQAGNAQAATADVN

SEQ ID NO: 5358 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRHDTAAYETVH

SEQ ID NO: 5359 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGSVTKSHLMFSQAGASDIRDQSRNWLPGPCYRQQRVSTTASHNNNSDFSWTGATTYHLNGRDSLVNPGPAMASHKDDDEKFFPQSGVLIFGKQGSEKTNVDIEKVMITDEEEIRTTNPVATEQYGSVSTNLQAGNAQAANEAVH

SEQ ID NO: 5360 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDTAASDADIERVMITDEEEIRTTNPVATEQYGSVSTNLQAGNAQAATADVN

SEQ ID NO: 5361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKENSGKANVDIKQVMITDEEEIRTTNPVATEQYGSVSTNLQAGNAQAATADVN

SEQ ID NO: 5362 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKENGGTNNVEIGNVMITDEEEIRTTNPVATEQYGSVSTNLQAGNAQAATADVN

SEQ ID NO: 5363 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5364 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESSAATNIDIEKVMITDEEEIRTTNPVATEQYGSVSTNLQAGNAQAATADVN

SEQ ID NO: 5365 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTDGENNNSDFSWTGATKYHLNGRDSLVNPGPAMASHKDDEEKFFPQSGVLIFGKQNSTATDIDVDGVMITDEEEIRTTNPVATEQYGSVSTNLQAGNAQAATADVN

SEQ ID NO: 5366 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTSADNNNSDFSWTGATTYHLNGRDSLVNPGPAMASHRDDEGKFFPQSGVLIFGKQDADKANAEFGQVMITDEEEIRTTNPVATEQYGSVSTNLQAGNAQAATADVN

SEQ ID NO: 5367 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEGTSGGDVEIEQVMITDEEEIRTTNPVATEQYGSVSTNLQAGNAQAATADVN

SEQ ID NO: 5368 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGIKTLSGLKFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5369 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTADHNNNSDFSWTGATKYHLNGRDSLVNPGPAMASHGDDAERFFPQSGVLIFGKQGSEKTNVDIEKVMITDEEEIRTTNPVATEQYGSVSTNLQAGNAQAATADVN

SEQ ID NO: 5370 - protein, 334 aa, Artificial Sequence; identical to SEQ ID NO: 157
  Synthetic

SEQ ID NO: 5371 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGRPTLSALGFSQAGASDIRDQSRNWLPGPCYRQQRVSTTSNENNNSDFSWTGATTYHLNGRDSLVNPGPAMASHEDDEEKFFPQSGVLIFGKQGSEKTNVDIEKVMITDEEEIRTTNPVATEQYGSVSTNLQRGNRQAATADVN

SEQ ID NO: 5372 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDEEKFFPQSGVLIFGKQDGGGNNVDIERVMITDEEEIRTTNPVATEQYGSVSTNLQAGNAQAATADVN

SEQ ID NO: 5373 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKQSSAAAVRDVH

SEQ ID NO: 5374 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNTTQSRLHFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5375 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKPPNGNNNSEFSWTGATTYHLNGRDSLVNPGPAMASHKDDDDRFFPQSGVLIFGKEGAGGTDVEIDSVMITDEEEIRTTNPVATEQYGSVSTNLQAGNAQAATADVN

SEQ ID NO: 5376 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSAGRPTNSHLKFSQAGASDIRDQSRNWLPGPCYRQQRVSKTDGENNNSDFSWTGATKYHLNGRDSLVNPGPAMASHKDDEGRFFPQSGVLIFGKENAGASDIAIDHVMITDEEEIRTTNPVATEQYGSVSTNLQRGNRQAATADVN

SEQ ID NO: 5377 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5378 - protein, 334 aa, Artificial Sequence; identical to SEQ ID NO: 1540
  Synthetic

SEQ ID NO: 5379 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSSATGDTEIDGVMITDEEEIRTTNPVATEQYGSVSTNLQRGNRQAATADVN

SEQ ID NO: 5380 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKEGGGKTNVDFDKVMITDEEEIRTTNPVATEQYGSVSTNLQAGNAQAATADVN

SEQ ID NO: 5381 - protein, 334 aa, Artificial Sequence; identical to SEQ ID NO: 4547
  Synthetic

SEQ ID NO: 5382 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTASSAAAYAAVN

SEQ ID NO: 5383 - protein, 334 aa, Artificial Sequence; identical to SEQ ID NO: 1237
  Synthetic

SEQ ID NO: 5384 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHRDDAGRFFPQSGVLIFGKQGSEKTNVDIEKVMITDEEEIRTTNPVATEQYGSVSTNLQAGNAQAATADVN

SEQ ID NO: 5385 - protein, 334 aa, Artificial Sequence; identical to SEQ ID NO: 4029
  Synthetic

SEQ ID NO: 5386 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5387 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDTDKFFPQSGVLIFGKQSGGRSNVEIDQVMITDEEEIRTTNPVATEQYGSVSTNLQAGNAQAATADVN

SEQ ID NO: 5388 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKTKTPAAFDGVN

SEQ ID NO: 5389 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDAEKFFPQSGVLIFGKQGSEKTNVDIEKVMITDEEEIRTTNPVATEQYGSVSTNLQAGNRQAATADVN

SEQ ID NO: 5390 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNDKFFPQSGVLIFGKEGSRRDDVDVEQVMITDEEEIRTTNPVATEQYGSVSTNLQAGNAQAATADVN

SEQ ID NO: 5391 - protein, 334 aa, Artificial Sequence; identical to SEQ ID NO: 712
  Synthetic

SEQ ID NO: 5392 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSRTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5393 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRSNGAAVAGVD

SEQ ID NO: 5394 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHKDDDDRFFPQSGVLIFGKQGAGGTNTDIGRVMITDEEEIRTTNPVATEQYGSVSTNLQAGNAQAATADVN

SEQ ID NO: 5395 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQSGSKNDIAIEDVMITDEEEIRTTNPVATEQYGSVSTNLQAGNAQAATADVN

SEQ ID NO: 5396 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSRTGTATQSRLQFSQAGASDIRDQSRNWLPGPCYRQQRVSTTPADNNNSDFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5397 - protein, 334 aa, Artificial Sequence; identical to SEQ ID NO: 1061
  Synthetic

SEQ ID NO: 5398 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQGTRGTAAADAVQ

SEQ ID NO: 5399 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQGARGNAATQDVK

SEQ ID NO: 5400 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGHAPAASERVN

SEQ ID NO: 5401 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNARGGIATISELGFSQAGASDIRDQSRNWLPGPCYRQQRVSKQSDRNNNSEFSWTGATKYHLNGRDSLVNPGPAMASHKDDEDKFFPQSGVLIFGKQGASTTNAAIEDVMITDEEEIRTTNPVATEQYGSVSTNLQAGNAQAATADVN

SEQ ID NO: 5402 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEDANGTNVEVDRVMITDEEEIRTTNPVATEQYGSVSTNLQAGNAQAATADVN

SEQ ID NO: 5403 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDDDKFFPQSGVLIFGKQGSEKTNVDIEKVMITDEEEIRTTNPVATEQYGSVSTNLQGPHAGAAFDTVA

SEQ ID NO: 5404 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAERFFPQSGVLIFGKQGSEKTNVDIEKVMITDEEEIRTTNPVATEQYGSVSTNLQAGNAQAATADVN

SEQ ID NO: 5405 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDADKANVDIGKVMITDEEEIRTTNPVATEQYGSVSTNLQAGNAQAATADVN

SEQ ID NO: 5406 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSARSAAAADDVA

SEQ ID NO: 5407 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATTYHLNGRDSLVNPGPAMASHKDDAEKFFPQSGVLIFGKQSAKAANAAIDEVMITDEEEIRTTNPVATEQYGSVSTNLQRGNRQAATADVN

SEQ ID NO: 5408 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSSGNNNSDFSWTGATTYHLNGRDSLVNPGPAMASHKDDDDKFFPQSGVLIFGKEGGSAANADVDQVMITDEEEIRTTNPVATEQYGSVSTNLQAGNAQAATADVN

SEQ ID NO: 5409 - protein, 334 aa, Artificial Sequence; identical to SEQ ID NO: 3557
  Synthetic

SEQ ID NO: 5410 - protein, 334 aa, Artificial Sequence; identical to SEQ ID NO: 372
  Synthetic

SEQ ID NO: 5411 - protein, 334 aa, Artificial Sequence; identical to SEQ ID NO: 3574
  Synthetic

SEQ ID NO: 5412 - protein, 334 aa, Artificial Sequence; identical to SEQ ID NO: 657
  Synthetic

SEQ ID NO: 5413 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTATRNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5414 - protein, 334 aa, Artificial Sequence
  Synthetic
STGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTQAADRAVN

SEQ ID NO: 5415 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDEAGRQTTSNLLFSQAGASDIRDQSRNWLPGPCYRQQRVSKTSADNNNSNFSWTGATKYHLNGRDSLVNPGPAMASHRDDEDKFFPQSGVLIFGKQGASETNVEIDKVMITDEEEIRTTNPVATEQYGSVSTNLQAGNAQAATADVN

SEQ ID NO: 5416 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGPPTTSQLSFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5417 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDEAGRQTTSNLLFSQAGASDIRDQSRNWLPGPCYRQQRVSKTSADNNNSNFSWTGATKYHLNGRDSLVNPGPAMASHRDDEDKFFPQSGVLIFGKQGASETNVEIDKVMITDEEEIRTTNPVATEQYGSVSTNLQAGNAQAATADVN

SEQ ID NO: 5418 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKQSAKAANAAIDEVMITDEEEIRTTNPVATEQYGSVSTNLQAGNAQAATADVN

SEQ ID NO: 5419 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHGDDAGRFFPQSGVLIFGKEGSTGSDVDVDRVMITDEEEIRTTNPVATEQYGSVSTNLQAGNAQAATADVN

SEQ ID NO: 5420 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKQPAGNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5421 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKTGNETPSRLMFSQAGASDIRDQSRNWLPGPCYRQQRVSKKSTGNNNSDFSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 5422 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSKTSSGNNNSDFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5423 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGRFFPQSGVLIFGKQGSEKTNVDIEKVMITDEEEIRTTNPVATEQYGSVSTNLQAGNAQAATADVN

SEQ ID NO: 5424 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGASESNVDVDGVMITDEEEIRTTNPVATEQYGSVSTNLQAGNAQAATADVN

SEQ ID NO: 5425 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTKDGAAYQEVA

SEQ ID NO: 5426 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSGADNIAIEGVMITDEEEIRTTNPVATEQYGSVSTNLQAGNAQAATADVN

SEQ ID NO: 5427 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQTRRDPAADNMVT

SEQ ID NO: 5428 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKENGTKGNIDIEKVMITDEEEIRTTNPVATEQYGSVSTNLQAGNAQAATADVN

SEQ ID NO: 5429 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTAAAAGEVA

SEQ ID NO: 5430 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSGKGGAAVTTVA

SEQ ID NO: 5431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTADHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5432 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKESSGEGNVDVDSVMITDEEEIRTTNPVATEQYGSVSTNLQAGNAQAATADVN

SEQ ID NO: 5433 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGHNTHSTLMFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5434 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 5435 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEYSWTGATKYHLNGRDSLVNPGPAMASHRDDNEKFFPQSGVLIFGKQGSEKTNVDIEKVMITDEEEIRTTNPVATEQYGSVSTNLQTPRNNAATEVVD

SEQ ID NO: 5436 - protein, 334 aa, Artificial Sequence; identical to SEQ ID NO: 631
  Synthetic

SEQ ID NO: 5437 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKQNSAGNDAAVDEVMITDEEEIRTTNPVATEQYGSVSTNLQAGNAQAATADVN

SEQ ID NO: 5438 - protein, 334 aa, Artificial Sequence; identical to SEQ ID NO: 3516
  Synthetic

SEQ ID NO: 5439 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5440 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGIMTLSELRFSQAGASDIRDQSRNWLPGPCYRQQRVSKTDGENNNSDFSWTGATKYHLNGRDSLVNPGPAMASHKDDEEKFFPQSGVLIFGKENAAANNADYESVMITDEEEIRTTNPVATEQYGSVSTNLQAGNAQAATADVN

SEQ ID NO: 5441 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSDFSWTGATKYHLNGRDSLVNPGPAMASHKDDDEKFFPQSGVLIFGKENGRGGNAEVEDVMITDEEEIRTTNPVATEQYGSVSTNLQAGNAQAATADVN

SEQ ID NO: 5442 - protein, 334 aa, Artificial Sequence; identical to SEQ ID NO: 2650
  Synthetic

SEQ ID NO: 5443 - protein, 334 aa, Artificial Sequence; identical to SEQ ID NO: 4568
  Synthetic

SEQ ID NO: 5444 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKENSSAGDVDIEKVMITDEEEIRTTNPVATEQYGSVSTNLQAGNAQAATADVN

SEQ ID NO: 5445 - protein, 334 aa, Artificial Sequence; identical to SEQ ID NO: 982
  Synthetic

SEQ ID NO: 5446 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNARNTAAAADVT

SEQ ID NO: 5447 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNGGTDTMSGLRFSQAGASDIRDQSRNWLPGPCYRQQRVSKKDSRNNNSDFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5448 - protein, 334 aa, Artificial Sequence; identical to SEQ ID NO: 738
  Synthetic

SEQ ID NO: 5449 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKQNAGKDDVDIDQVMITDEEEIRTTNPVATEQYGSVSTNLQAGNAQAATADVN

SEQ ID NO: 5450 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGTARNNVDIERVMITDEEEIRTTNPVATEQYGSVSTNLQAGNAQAATADVN

SEQ ID NO: 5451 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQNTPAAIRTVA

SEQ ID NO: 5452 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNGGRTTQSNLGFSQAGASDIRDQSRNWLPGPCYRQQRVSTTASHNNNSDFSWTGATKYHLNGRDSLVNPGPAMASHKDDDERFFPQSGVLIFGKQGAGKNNAAIGQVMITDEEEIRTTNPVATEQYGSVSTNLQAGNAQAATADVN

SEQ ID NO: 5453 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5454 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSGKSNVAFGDVMITDEEEIRTTNPVATEQYGSVSTNLQAGNAQAATADVN

SEQ ID NO: 5455 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTKSGAASSGVD

SEQ ID NO: 5456 - protein, 334 aa, Artificial Sequence; identical to SEQ ID NO: 3321
  Synthetic

SEQ ID NO: 5457 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQSARGTNADIDEVMITDEEEIRTTNPVATEQYGSVSTNLQAGNAQAATADVN

SEQ ID NO: 5458 - protein, 334 aa, Artificial Sequence; identical to SEQ ID NO: 2828
  Synthetic

SEQ ID NO: 5459 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKQNATGTNVDVGSVMITDEEEIRTTNPVATEQYGSVSTNLQAGNAQAATADVN

SEQ ID NO: 5460 - protein, 334 aa, Artificial Sequence; identical to SEQ ID NO: 378
  Synthetic

SEQ ID NO: 5461 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSTTASHNNNSDFSWTGATKYHLNGRDSLVNPGPAMASHKDDEEKFFPQSGVLIFGKQGASETNVEIDKVMITDEEEIRTTNPVATEQYGSVSTNLQAGNAQAATADVN

SEQ ID NO: 5462 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLRFSQAGASDIRDQSRNWLPGPCYRQQRVSKVSADNNNSEFSWTGATKYHLNGRDSLVNPGPAMASHKDDEEKFFPQSGVLIFGKESSAATNIDIEKVMITDEEEIRTTNPVATEQYGSVSTNLQAGNAQAATADVN

SEQ ID NO: 5463 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTEKSNIEIGDVMITDEEEIRTTNPVATEQYGSVSTNLQAGNAQAATADVN

SEQ ID NO: 5464 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQADNGGAAVQGVA

SEQ ID NO: 5465 - protein, 334 aa, Artificial Sequence; identical to SEQ ID NO: 697
  Synthetic

SEQ ID NO: 5466 - protein, 334 aa, Artificial Sequence; identical to SEQ ID NO: 432
  Synthetic

SEQ ID NO: 5467 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKYDEEKFFPQSGVLIFGKQGSEKTNVDIEKVMITDEEEIRTTNPVATEQYGSVSTNLQGKRGTAADDSVN

SEQ ID NO: 5468 - protein, 334 aa, Artificial Sequence; identical to SEQ ID NO: 1950
  Synthetic

SEQ ID NO: 5469 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQDASGSDVDYERVMITDEEEIRTTNPVATEQYGSVSTNLQAGNAQAATADVN

SEQ ID NO: 5470 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKTAGQNNNSNFSWTGATKYHLNGRDSLVNPGPAMASHKDDDDKFFPQSGVLIFGKEGAGTNDIDIERVMITDEEEIRTTNPVATEQYGSVSTNLQAGNAQAATADVN

SEQ ID NO: 5471 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGTDTISRLQFSQAGASDIRDQSRNWLPGPCYRQQRVSKTHGDNNNSNFSWTGATTYHLNGRDSLVNPGPAMASHKDDAEKFFPQSGVLIFGKQSAKAANAAIDEVMITDEEEIRTTNPVATEQYGSVSTNLQAGNAQAATADVN

SEQ ID NO: 5472 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSAKGSNAAYDSVMITDEEEIRTTNPVATEQYGSVSTNLQAGNAQAATADVN

SEQ ID NO: 5473 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPAGNNNSEFSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 5474 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNLTISRLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 5475 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNAGSTTTSELGFSQAGASDIRDQSRNWLPGPCYRQQRVSTTPNENNNSDFSWTGATKYHLNGRDSLVNPGPAMASHRDDEDKFFPQSGVLIFGKEGSEKTNVDIEKVMITDEEEIRTTNPVATEQYGSVSTNLQRGNRQAATADVN

SEQ ID NO: 5476 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKKDSRNNNSDFSWTGATKYHLNGRDSLVNPGPAMASHKDDDDRFFPQSGVLIFGKQDATATNADYEHVMITDEEEIRTTNPVATEQYGSVSTNLQAGNAQAATADVN

SEQ ID NO: 5477 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5478 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSNFSWTGATKYHLNGRDSLVNPGPAMASHKDDEDKFFPQSGVLIFGKQGSAAANIEIEQVMITDEEEIRTTNPVATEQYGSVSTNLQAGNAQAATADVN

SEQ ID NO: 5479 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRQSTAASTEVQ

SEQ ID NO: 5480 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 5481 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNGGPTTQSTLRFSQAGASDIRDQSRNWLPGPCYRQQRVSKTYNDNNNSDFSWTGATKYHLNGRDSLVNPGPAMASHKDDDEKFFPQSGVLIFGKQSGGATNVAFGDVMITDEEEIRTTNPVATEQYGSVSTNLQAGNAQAATADVN

SEQ ID NO: 5482 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNMTLSQLGFSQAGASDIRDQSRNWLPGPCYRQQRVSKQSSDNNNSEFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 5483 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRGGSPTKSSLNFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5484 - protein, 334 aa, Artificial Sequence; identical to SEQ ID NO: 891
  Synthetic

SEQ ID NO: 5485 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGITTNSRLSFSQAGASDIRDQSRNWLPGPCYRQQRVSTQASGNNNSEFSWTGATKYHLNGRDSLVNPGPAMASHKDDDEKFFPQSGVLIFGKEGATASNAAFDEVMITDEEEIRTTNPVATEQYGSVSTNLQAGNAQAATADVN

SEQ ID NO: 5486 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGTTTLSRLSFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5487 - protein, 334 aa, Artificial Sequence; identical to SEQ ID NO: 420
  Synthetic

SEQ ID NO: 5488 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 5489 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSNRADVEIDRVMITDEEEIRTTNPVATEQYGSVSTNLQAGNAQAATADVN

SEQ ID NO: 5490 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKGGNVTLSTLKFSQAGASDIRDQSRNWLPGPCYRQQRVSKQPAGNNNSEFSWTGATKYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 5491 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQSAKAANAAIDEVMITDEEEIRTTNPVATEQYGSVSTNLQAGNAQAATADVN

SEQ ID NO: 5492 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDERGHAASDNVE

SEQ ID NO: 5493 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKEGAEADNAAFEKVMITDEEEIRTTNPVATEQYGSVSTNLQAGNAQAATADVN

SEQ ID NO: 5494 - protein, 334 aa, Artificial Sequence; identical to SEQ ID NO: 898
  Synthetic

SEQ ID NO: 5495 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQSTDRANVDIEKVMITDEEEIRTTNPVATEQYGSVSTNLQAGNAQAATADVN

SEQ ID NO: 5496 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKEGAEGTNADIENVMITDEEEIRTTNPVATEQYGSVSTNLQAGNAQAATADVN

SEQ ID NO: 5497 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTNTQSRLQFSQAGASDIRDQSRNWLPGPCYRQQRVSKTSADNNNSEYSWTGATKYHLNGRDSLVNPGPAMASHRDDDDKFFPQSGVLIFGKEDSKANNVAIDKVMITDEEEIRTTNPVATEQYGSVSTNLQAGNAQAATADVN

SEQ ID NO: 5498 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHRDDEDKFFPQSGVLIFGKESTGGNDVEYDQVMITDEEEIRTTNPVATEQYGSVSTNLQAGNAQAATADVN

SEQ ID NO: 5499 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPTRNNNSEFSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 5500 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5501 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKQSSDNNNSEFSWTGATKYHLNGRDSLVNPGPAMASHKDDDDRFFPQSGVLIFGKEGAGGSNVAVDGVMITDEEEIRTTNPVATEQYGSVSTNLQAGNAQAATADVN

SEQ ID NO: 5502 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQAARTTAASGGVD

SEQ ID NO: 5503 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEAGSLTKSQLRFSQAGASDIRDQSRNWLPGPCYRQQRVSKQPGDNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5504 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDKFFPQSGVLIFGKQGAGTNNVDNDEVMITDEEEIRTTNPVATEQYGSVSTNLQAGNAQAATADVN

SEQ ID NO: 5505 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKESAGATNVDYERVMITDEEEIRTTNPVATEQYGSVSTNLQAGNAQAATADVN

SEQ ID NO: 5506 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHKDDDERFFPQSGVLIFGKQGSTGTNTDIGQVMITDEEEIRTTNPVATEQYGSVSTNLQAGNAQAATADVN

SEQ ID NO: 5507 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGLQTMSALKFSQAGASDIRDQSRNWLPGPCYRQQRVSKKDSRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5508 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGASTTNVEIGHVMITDEEEIRTTNPVATEQYGSVSTNLQAGNAQAATADVN

SEQ ID NO: 5509 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5510 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDADNNNSDFSWPGATKYHLNGRDSLVNPGPAMASHGDDKEKFFPQSGVLIFGKQSSGKSNIAIEGVMITDEEEIRTTNPVATEQYGSVSTNLQAGNAQAATADVN

SEQ ID NO: 5511 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGRMTTSRLEFSQAGASDIRDQSRNWLPGPCYRQQRVSKTHGDNNNSNFSWTGATTYHLNGRDSLVNPGPAMASHKDDAEKFFPQSGVLIFGKEGAGKTNIAIDDVMITDEEEIRTTNPVATEQYGSVSTNLQAGNAQAATADVN

SEQ ID NO: 5512 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDADNNNSDFSWTGATTYHLNGRDSLVNPGPAMASHRDDDGKFFPQSGVLIFGKQSTAEGNVDFEKVMITDEEEIRTTNPVATEQYGSVSTNLQAGNAQAATADVN

SEQ ID NO: 5513 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGTPTHSTLKFSQAGASDIRDQSRNWLPGPCYRQQRVSTQSTGNNNSEYSWTGATKYHLNGRDSLVNPGPAMASHKDDEEKFFPQSGVLIFGKQDAKGTNIDFDGVMITDEEEIRTTNPVATEQYGSVSTNLQAGNAQAATADVN

SEQ ID NO: 5514 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKQSGQNNNSDFSWTGATKYHLNGRDSLVNPGPAMASHKDDEGKFFPQSGVLIFGKQGSAASNADVGQVMITDEEEIRTTNPVATEQYGSVSTNLQAGNAQAATADVN

SEQ ID NO: 5515 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5516 - protein, 334 aa, Artificial Sequence
  Synthetic
DTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDEKFFPQSGVLIFGKQGSEKTNVDIEKVMITDEEEIRTTNPVATEQYGSVSTNLQSNSTQAAYHVVE

SEQ ID NO: 5517 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQSTGADNVDIEQVMITDEEEIRTTNPVATEQYGSVSTNLQAGNAQAATADVN

SEQ ID NO: 5518 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSDDNNNSNFSWTGATTYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 5519 - protein, 334 aa, Artificial Sequence; identical to SEQ ID NO: 1228
  Synthetic

SEQ ID NO: 5520 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPAGNNNSEFSWTGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 5521 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNMTNSTLRFSQAGASDIRDQSRNWLPGPCYRQQRVSTQDSDNNNSNFSWTGATKYHLNGRDSLVNPGPAMASHKDDAEKFFPQSGVLIFGKQSAKAANAAIDEVMITDEEEIRTTNPVATEQYGSVSTNLQAGNAQAATADVN

SEQ ID NO: 5522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGTNESDVDIEKVMITDEEEIRTTNPVATEQYGSVSTNLQAGNAQAATADVN

SEQ ID NO: 5523 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPRASAAFKRVD

SEQ ID NO: 5524 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5525 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQAGNAQAATADVN

SEQ ID NO: 5526 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKPPNDNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5527 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTRATKYHLNGRDSLVNPGPAMASHKDDDEKFFPQSGVLIFGKQGTGKNNAAIGQVMITDEEEIRTTNPVATEQYGSVSTNLQAGNAQAATADVN

SEQ ID NO: 5528 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 5529 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSDTGITTLSRLQFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 5530 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRSGAAFTGVN

SEQ ID NO: 5531 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLRFSQAGASDIRDQSRNWLPGPCYRQQRVSTKDTDNNNSNFSWTGATKYHLNGRDSLVNPGPAMASHKDDDDRFFPQSGVLIFGKEDAGTTNVAFDKVMITDEEEIRTTNPVATEQYGSVSTNLQAGNAQAATADVN

SEQ ID NO: 5532 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGRANDADIESVMITDEEEIRTTNPVATEQYGSVSTNLQAGNAQAATADVN

SEQ ID NO: 5533 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5534 - protein, 334 aa, Artificial Sequence; identical to SEQ ID NO: 4571
  Synthetic

SEQ ID NO: 5535 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTSTPSGTTTQSRLQFSQAGASDIRDQSRNWLPGPCYRQQRVSKVSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 5536 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDDDNNNSDFSWTGATKYHLNGRDSLVNPGPAMASHEDDADKFFPQSGVLIFGKEGSRRANVDIEYVMITDEEEIRTTNPVATEQYGSVSTNLQAGNAQAATADVN

SEQ ID NO: 5537 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQGGIATQSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5538 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNTQAASDVVD

SEQ ID NO: 5539 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKQSDRNNNSEFSWTGATKYHLNGRDSLVNPGPAMASHKDDEDKFFPQSGVLIFGKEDAGTTNVAFDKVMITDEEEIRTTNPVATEQYGSVSTNLQAGNAQAATADVN

SEQ ID NO: 5540 - protein, 334 aa, Artificial Sequence; identical to SEQ ID NO: 3434
  Synthetic

SEQ ID NO: 5541 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLRFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 5542 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTASGNVTQSTLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5543 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPGGRMTLSGLQFSQAGASDIRDQSRNWLPGPCYRQQRVSKQSADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5544 - protein, 334 aa, Artificial Sequence; identical to SEQ ID NO: 647
  Synthetic

SEQ ID NO: 5545 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKENGAGNNTEVENVMITDEEEIRTTNPVATEQYGSVSTNLQAGNAQAATADVN

SEQ ID NO: 5546 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKENSSAGDVDIEKVMITDEEEIRTTNPVATEQYGSVSTNLQAGNAQAATADVN

SEQ ID NO: 5547 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDEKFFPQSGVLIFGKQSGEKNDVDIDGVMITDEEEIRTTNPVATEQYGSVSTNLQAGNAQAATADVN

SEQ ID NO: 5548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGKATISGLKFSQAGASDIRDQSRNWLPGPCYRQQRVSKQPNDNNNSEFSWTGATTYHLNGRDSLVNPGPAMASHRDDEEKFFPQSGVLIFGKQDASKNNVDVDGVMITDEEEIRTTNPVATEQYGSVSTNLQAGNAQAATADVN

SEQ ID NO: 5549 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHEDDNGKFFPQSGVLIFGKEGGAATDVDIDQVMITDEEEIRTTNPVATEQYGSVSTNLQAGNAQAATADVN

SEQ ID NO: 5550 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLLFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5551 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSSTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARTRAADNVVE

SEQ ID NO: 5552 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDERFFPQSGVLIFGKQGGEKADVAIGDVMITDEEEIRTTNPVATEQYGSVSTNLQAGNAQAATADVN

SEQ ID NO: 5553 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTDNNNSDFSWTGATKYHLNGRDSLVNPGPAMASHEDDNDKFFPQSGVLIFGKQGSTGTNTDIGQVMITDEEEIRTTNPVATEQYGSVSTNLQAGNAQAATADVN

SEQ ID NO: 5554 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHEDDTDRFFPQSGVLIFGKQGSEKTNVDIEKVMITDEEEIRTTNPVATEQYGSVSTNLQRGNRQAATADVN

SEQ ID NO: 5555 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQPNDNNNSEFSWTGATTYHLNGRDSLVNPGPAMASHKDDADRFFPQSGVLIFGKQDSGRANVDFEKVMITDEEEIRTTNPVATEQYGSVSTNLQAGNAQAATADVN

SEQ ID NO: 5556 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSKSGPATKSALGFSQAGASDIRDQSRNWLPGPCYRQQRVSKVSADNNNSVFSWTGATKYHLNGRDSLVNPGPAMASHKDDEEKFFPQSGVLIFGKQDGGGNNVDIERVMITDEEEIRTTNPVATEQYGSVSTNLQAGNAQAATADVN

SEQ ID NO: 5557 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESSTGTNIDFDRVMITDEEEIRTTNPVATEQYGSVSTNLQAGNAQAATADVN

SEQ ID NO: 5558 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 5559 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLIFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5560 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSEFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5561 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAKGNAASGDVT

SEQ ID NO: 5563 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVAVEKVMITDEEEIRTTNPVATEQYGSVSTNLQAGNAQAATADVN

SEQ ID NO: 5564 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 5565 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTYNDNNNSEFSWTGATTYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 5566 - protein, 334 aa, Artificial Sequence; identical to SEQ ID NO: 683
  Synthetic

SEQ ID NO: 5567 - protein, 334 aa, Artificial Sequence; identical to SEQ ID NO: 3830
  Synthetic

SEQ ID NO: 5568 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNTRGPAANGIVN

SEQ ID NO: 5569 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGSTTHSTLNFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 5570 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKQSGKETDVDIGQVMITDEEEIRTTNPVATEQYGSVSTNLQAGNAQAATADVN

SEQ ID NO: 5571 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQRGNRQAATADVN

SEQ ID NO: 5572 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGASGSQTHSGLMFSQAGASDIRDQSRNWLPGPCYRQQRVSKPANGNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5573 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGSGKDNVEVGQVMITDEEEIRTTNPVATEQYGSVSTNLQAGNAQAATADVN

SEQ ID NO: 5574 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHKDDKEKFFPQSGVLIFGKQGSEKTNVDIEKVMITDEEEIRTTNPVATEQYGSVSTNLQAGNAQAATADVN

SEQ ID NO: 5575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGIETKSRLLFSQAGASDIRDQSRNWLPGPCYRQQRVSKTYNDNNNSEFSWTGATTYHLNGRDSLVNPGPAMASHRDDDGKFFPQSGVLIFGKQGSEKTNVDIEKVMITDEEEIRTTNPVATEQYGSVSTNLQAGNAQAATADVN

SEQ ID NO: 5576 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDERFFPQSGVLIFGKQDTGEADADVDGVMITDEEEIRTTNPVATEQYGSVSTNLQAGNAQAATADVN

SEQ ID NO: 5577 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGTRKNDVAIDEVMITDEEEIRTTNPVATEQYGSVSTNLQAGNAQAATADVN

SEQ ID NO: 5578 - protein, 334 aa, Artificial Sequence; identical to SEQ ID NO: 1324
  Synthetic

SEQ ID NO: 5579 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRATAAADGVQ

SEQ ID NO: 5580 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHTGLKTNSRLGFSQAGASDIRDQSRNWLPGPCYRQQRVSKVSADNNNSEFSWTGATKYHLNGRDSLVNPGPAMASHKDDEEKFFPQSGVLIFGKQGAGRADIEVGSVMITDEEEIRTTNPVATEQYGSVSTNLQAGNAQAATADVN

SEQ ID NO: 5581 - protein, 334 aa, Artificial Sequence; identical to SEQ ID NO: 2567
  Synthetic

SEQ ID NO: 5582 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRATAAADGVQ

SEQ ID NO: 5584 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGPATKSTLRFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 5585 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGLQTHSRLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5586 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKQSSDNNNSEFSWTGATKYHLNGRDSLVNPGPAMASHEDDNEKFFPQSGVLIFGKEDAKGNDVAIENVMITDEEEIRTTNPVATEQYGSVSTNLQAGNAQAATADVN

SEQ ID NO: 5587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDGAGDNIEVDQVMITDEEEIRTTNPVATEQYGSVSTNLQAGNAQAATADVN

SEQ ID NO: 5588 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 5589 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHEDDNEKFFPQSGVLIFGKEGSEKTNVDIEKVMITDEEEIRTTNPVATEQYGSVSTNLQRGNRQAATADVN

SEQ ID NO: 5590 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRSGRAANRGVD

SEQ ID NO: 5591 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRDGAAVANVA

SEQ ID NO: 5592 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPDGNNNSNFSWTGATKYHLNGRDSLVNPGPAMASHKDDEDRFFPQSGVLIFGKQGSEKTNVDIEKVMITDEEEIRTTNPVATEQYGSVSTNLQAGNAQAATADVN

SEQ ID NO: 5593 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPGGRMTLSGLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5594 - protein, 334 aa, Artificial Sequence; identical to SEQ ID NO: 1354
  Synthetic

SEQ ID NO: 5595 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5596 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGQNRAAVDTVH

SEQ ID NO: 5597 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5598 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSAGNVTKSGLRFSQAGASDIRDQSRNWLPGPCYRQQRVSKTHGDNNNSNFSWTGATTYHLNGRDSLVNPGPAMASHRDDNEKFFPQSGVLIFGKQSAGANNVEIESVMITDEEEIRTTNPVATEQYGSVSTNLQAGNAQAATADVN

SEQ ID NO: 5599 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQSHAAFTMVD

SEQ ID NO: 5600 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRNGAATGKVD

SEQ ID NO: 5601 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKEGSGKANVEIGRVMITDEEEIRTTNPVATEQYGSVSTNLQAGNAQAATADVN

SEQ ID NO: 5602 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARNGQAAIDVVH

SEQ ID NO: 5603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAGNNNSNFSWTGATKYHLNGRDSLVNPGPAMASHKDDTGRFFPQSGVLIFGKQGSEKTNVDIEKVMITDEEEIRTTNPVATEQYGSVSTNLQAGNAQAATADVN

SEQ ID NO: 5604 - protein, 334 aa, Artificial Sequence; identical to SEQ ID NO: 3693
  Synthetic

SEQ ID NO: 5605 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKEGSKASNVAVDRVMITDEEEIRTTNPVATEQYGSVSTNLQAGNAQAATADVN

SEQ ID NO: 5606 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYGDNNNSEFSWTGATTYHLNGRDSLVNPGPAMASHKDDDERFFPQSGVLIFGKENGDKTNVEIDRVMITDEEEIRTTNPVATEQYGSVSTNLQAGNAQAATADVN

SEQ ID NO: 5607 - protein, 334 aa, Artificial Sequence; identical to SEQ ID NO: 1887
  Synthetic

SEQ ID NO: 5608 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGAGGRATLSDLRFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 5609 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKGQNGAAVEGVH

SEQ ID NO: 5610 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTVTQSQLGFSQAGASDIRDQSRNWLPGPCYRQQRVSKQPAGNNNSEFSWTGATKYHLNGRDSLVNPGPAMASHRDDNDRFFPQSGVLIFGKQGSEKTNVDIEKVMITDEEEIRTTNPVATEQYGSVSTNLQAGNAQAATADVN

SEQ ID NO: 5611 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSERTGAADGTVT

SEQ ID NO: 5612 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSHRTPAADNEVA

SEQ ID NO: 5613 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNITKSELRFSQAGASDIRDQSRNWLPGPCYRQQRVSKTSADNNNSEYSWTGATKYHLNGRDSLVNPGPAMASHKDDEEKFFPQSGVLIFGKESGARNDVDIDSVMITDEEEIRTTNPVATEQYGSVSTNLQAGNAQAATADVN

SEQ ID NO: 5614 - protein, 334 aa, Artificial Sequence; identical to SEQ ID NO: 1246
  Synthetic

SEQ ID NO: 5615 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGTNTMSTLQFSQAGASDIRDQSRNWLPGPCYRQQRVSKKSTGNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5616 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPADNNNSDFSWTGATKYHLNGRDSLVNPGPAMASHKDDNDKFFPQSGVLIFGKEGAKGSDVAYEGVMITDEEEIRTTNPVATEQYGSVSTNLQAGNAQAATADVN

SEQ ID NO: 5617 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 5618 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRSGAAATRSVA

SEQ ID NO: 5619 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5620 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPSGNNNSNFSWTGATKYHLNGRDSLVNPGPAMASHKDDEDKFFPQSGVLIFGKESGTTANADIEHVMITDEEEIRTTNPVATEQYGSVSTNLQAGNAQAATADVN

SEQ ID NO: 5621 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPSRNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5622 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQNGSTTNVDIGGVMITDEEEIRTTNPVATEQYGSVSTNLQAGNAQAATADVN

SEQ ID NO: 5623 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLRFSQAGASDIRDQSRNWLPGPCYRQQRVSKTSADNNNSEYSWTGATKYHLNGRDSLVNPGPAMASHKDDAGKFFPQSGVLIFGKEGGGTSNAEIDKVMITDEEEIRTTNPVATEQYGSVSTNLQAGNAQAATADVN

SEQ ID NO: 5624 - protein, 334 aa, Artificial Sequence; identical to SEQ ID NO: 633
  Synthetic

SEQ ID NO: 5625 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGIETNSTLRFSQAGASDIRDQSRNWLPGPCYRQQRVSKQASDNNNSNFSWTGATTYHLNGRDSLVNPGPAMASHEDDDGRFFPQSGVLIFGKQGSEKTNVDIEKVMITDEEEIRTTNPVATEQYGSVSTNLQRGNRQAATADVN

SEQ ID NO: 5626 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTTSTLQFSQAGASDIRDQSRNWLPGPCYRQQRVSKTDGENNNSDFSWTGATKYHLNGRDSLVNPGPAMASHKDDEEKFFPQSGVLIFGKQSSDKDNVDFGDVMITDEEEIRTTNPVATEQYGSVSTNLQAGNAQAATADVN

SEQ ID NO: 5627 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSTTPADNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5628 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDPAADGTVH

SEQ ID NO: 5629 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGSEKTNVDIEKVMITDEEEIRTTNPVATEQYGSVSTNLQAGNAQAATADVN

SEQ ID NO: 5630 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEGSTEGNVDVDSVMITDEEEIRTTNPVATEQYGSVSTNLQAGNAQAATADVN

SEQ ID NO: 5631 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDKGKFFPQSGVLIFGKQGSEKTNVDIEKVMITDEEEIRTTNPVATEQYGSVSTNLQAGNAQAATADVN

SEQ ID NO: 5632 - protein, 334 aa, Artificial Sequence; identical to SEQ ID NO: 2915
  Synthetic

SEQ ID NO: 5633 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGTVTMSTLEFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5634 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTSAGRITTSGLRFSQAGASDIRDQSRNWLPGPCYRQQRVSKKDDGNNNSNFSWTGATKYHLNGRDSLVNPGPAMASHKDDDDRFFPQSGVLIFGKEDSAGNDIAIGEVMITDEEEIRTTNPVATEQYGSVSTNLQAGNAQAATADVN

SEQ ID NO: 5635 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQPNDNNNSEFSWTGATTYHLNGRDSLVNPGPAMASHKDDADRFFPQSGVLIFGKQDSGRANVDFEKVMITDEEEIRTTNPVATEQYGSVSTNLQAGNAQAATADVN

SEQ ID NO: 5636 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGTGRDTMSALLFSQAGASDIRDQSRNWLPGPCYRQQRVSKTSADNNNSNFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5637 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARTPAAFAGVH

SEQ ID NO: 5638 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGTLTPSGLGFSQAGASDIRDQSRNWLPGPCYRQQRVSKQPSENNNSDFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5639 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5640 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAAGADTAIDDVMITDEEEIRTTNPVATEQYGSVSTNLQAGNAQAATADVN

SEQ ID NO: 5641 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5642 - protein, 334 aa, Artificial Sequence; identical to SEQ ID NO: 2986
  Synthetic

SEQ ID NO: 5643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSRNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5644 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGSEGANAAIEEVMITDEEEIRTTNPVATEQYGSVSTNLQAGNAQAATADVN

SEQ ID NO: 5645 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQATQNNNSNFSWTGATTYHLNGRDSLVNPGPAMASHKDDNERFFPQSGVLIFGKEDAGTTNVAFDKVMITDEEEIRTTNPVATEQYGSVSTNLQAGNAQAATADVN

SEQ ID NO: 5646 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSTKAADNNNSNFSWTGATTYHLNGRDSLVNPGPAMASHRDDDERFFPQSGVLIFGKEGSRKNNAEFGEVMITDEEEIRTTNPVATEQYGSVSTNLQAGNAQAATADVN

SEQ ID NO: 5647 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQAHAASDMVE

SEQ ID NO: 5648 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDGGTTTKSQLRFSQAGASDIRDQSRNWLPGPCYRQQRVSKTSADNNNSEFSWTGATTYHLNGRDSLVNPGPAMASHKDDDDRFFPQSGVLIFGKESAGRSDTAIDEVMITDEEEIRTTNPVATEQYGSVSTNLQAGNAQAATADVN

SEQ ID NO: 5649 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDKFFPQSGVLIFGKEGGERNDVEVDEVMITDEEEIRTTNPVATEQYGSVSTNLQAGNAQAATADVN

SEQ ID NO: 5650 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5651 - protein, 334 aa, Artificial Sequence; identical to SEQ ID NO: 200
  Synthetic

SEQ ID NO: 5652 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 5653 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGSTRSNAEIGSVMITDEEEIRTTNPVATEQYGSVSTNLQAGNAQAATADVN

SEQ ID NO: 5654 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 5655 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 5656 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAAGNKTLSGLLFSQAGASDIRDQSRNWLPGPCYRQQRVSKTPNGNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 5657 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDGNGSDVEIDQVMITDEEEIRTTNPVATEQYGSVSTNLQAGNAQAATADVN

SEQ ID NO: 5658 - protein, 334 aa, Artificial Sequence; identical to SEQ ID NO: 429
  Synthetic

SEQ ID NO: 5659 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGASESNVDVDGVMITDEEEIRTTNPVATEQYGSVSTNLQAGNAQAATADVN

SEQ ID NO: 5660 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAAGGRVTLSKLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5661 - protein, 334 aa, Artificial Sequence; identical to SEQ ID NO: 2965
  Synthetic

SEQ ID NO: 5662 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5663 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRNTTSSLGFSQAGASDIRDQSRNWLPGPCYRQQRVSKRPTDNNNSDFSWTGATKYHLNGRDSLVNPGPAMASHGDDKGRFFPQSGVLIFGKQGSEKTNVDIEKVMITDEEEIRTTNPVATEQYGSVSTNLQAGNAQAATADVN

SEQ ID NO: 5664 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRNNPAADGVVT

SEQ ID NO: 5665 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPNNQAAVGAVK

SEQ ID NO: 5666 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGAAAVHNVA

SEQ ID NO: 5667 - protein, 334 aa, Artificial Sequence; identical to SEQ ID NO: 3226
  Synthetic

SEQ ID NO: 5668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAQAQAAAPDVT

SEQ ID NO: 5669 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTDKFFPQSGVLIFGKQGSEKTNVDIEKVMITDEEEIRTTNPVATEQYGSVSTNLQAGNAQAATADVN

SEQ ID NO: 5670 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQSTGNNNSDFSWTGATKYHLNGRDSLVNPGPAMASHKDDAEKFFPQSGVLIFGKQGSEKTNVDIEKVMITDEEEIRTTNPVATEQYGSVSTNLQGQKDRAASTDVH

SEQ ID NO: 5671 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKENTKGDNVDIDKVMITDEEEIRTTNPVATEQYGSVSTNLQAGNAQAATADVN

SEQ ID NO: 5672 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5673 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQDGENNNSDFSWTGATKYHLNGRDSLVNPGPAMASHKDDEDKFFPQSGVLIFGKEDSGAGNVAVEGVMITDEEEIRTTNPVATEQYGSVSTNLQAGNAQAATADVN

SEQ ID NO: 5674 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKQTTAASEGVT

SEQ ID NO: 5675 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5676 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 5677 - protein, 334 aa, Artificial Sequence; identical to SEQ ID NO: 817
  Synthetic

SEQ ID NO: 5678 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNMTTSALRFSQAGASDIRDQSRNWLPGPCYRQQRVSKKDSRNNNSDFSWTGATTYHLNGRDSLVNPGPAMASHRDDDEKFFPQSGVLIFGKQGAEATDVAFDSVMITDEEEIRTTNPVATEQYGSVSTNLQAGNAQAATADVN

SEQ ID NO: 5679 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGIITPSDLRFSQAGASDIRDQSRNWLPGPCYRQQRVSKTDGENNNSDFSWTGATKYHLNGRDSLVNPGPAMASHKDDEEKFFPQSGVLIFGKQGAGANNVDFGEVMITDEEEIRTTNPVATEQYGSVSTNLQRGNRQAATADVN

SEQ ID NO: 5680 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKEGATATNVEIDDVMITDEEEIRTTNPVATEQYGSVSTNLQAGNAQAATADVN

SEQ ID NO: 5681 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTDGENNNSDFSWTGATKYHLNGRDSLVNPGPAMASHKDDEEKFFPQSGVLIFGKQSARGTDVAVDDVMITDEEEIRTTNPVATEQYGSVSTNLQAGNAQAATADVN

SEQ ID NO: 5682 - protein, 334 aa, Artificial Sequence; identical to SEQ ID NO: 1244
  Synthetic

SEQ ID NO: 5683 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5684 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTARNPAAFERVT

SEQ ID NO: 5685 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTAGRNNNSEYSWTGATTYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 5686 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKKSTDNNNSEFSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5687 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGLLTTSALKFSQAGASDIRDQSRNWLPGPCYRQQRVSKQPGDNNNSNFSWTGATKYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 5688 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKQDTDNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5689 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGATRANVAIDEVMITDEEEIRTTNPVATEQYGSVSTNLQAGNAQAATADVN

SEQ ID NO: 5690 - protein, 334 aa, Artificial Sequence; identical to SEQ ID NO: 715
  Synthetic

SEQ ID NO: 5691 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQRGNAQAATADVN

SEQ ID NO: 5692 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 5693 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDAGGSDIDYESVMITDEEEIRTTNPVATEQYGSVSTNLQAGNAQAATADVN

SEQ ID NO: 5694 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGRTTPSTLLFSQAGASDIRDQSRNWLPGPCYRQQRVSKQSSDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5695 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKQSTGADNVDIEQVMITDEEEIRTTNPVATEQYGSVSTNLQAGNAQAATADVN

SEQ ID NO: 5696 - protein, 334 aa, Artificial Sequence; identical to SEQ ID NO: 2313
  Synthetic

SEQ ID NO: 5697 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKAGSATTSALGFSQAGASDIRDQSRNWLPGPCYRQQRVSKQASDNNNSEFSWTGATTYHLNGRDSLVNPGPAMASHKDDNDKFFPQSGVLIFGKQNTGRTNAAIEQVMITDEEEIRTTNPVATEQYGSVSTNLQAGNAQAATADVN

SEQ ID NO: 5698 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTEKFFPQSGVLIFGKQGSEKTNVDIEKVMITDEEEIRTTNPVATEQYGSVSTNLQRGNRQAATADVN

SEQ ID NO: 5699 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTHAADKAVN

SEQ ID NO: 5700 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 5701 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGNPTMSELRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5702 - protein, 334 aa, Artificial Sequence; identical to SEQ ID NO: 3501
  Synthetic

SEQ ID NO: 5703 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPADNNNSDFSWTGATKYHLNGRDSLVNPGPAMASHGDDDERFFPQSGVLIFGKQSGTANNIEFGQVMITDEEEIRTTNPVATEQYGSVSTNLQAGNAQAATADVN

SEQ ID NO: 5704 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGSEKTNVDIEKVMITDEEEIRTTNPVATEQYGSVSTNLQGNQTQAATTGVP

SEQ ID NO: 5705 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRSGHDTLSNLLFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 5706 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSTKDDWNNNSDFSWTGATKYHLNGRDSLVNPGPAMASHKDDNDKFFPQSGVLIFGKQGSEKTNVDIEKVMITDEEEIRTTNPVATEQYGSVSTNLQAGNAQAATADVN

SEQ ID NO: 5707 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNTQAASDVVD

SEQ ID NO: 5708 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQAGSVTQSALRFSQAGASDIRDQSRNWLPGPCYRQQRVSKQYTDNNNSNFSWTGATTYHLNGRDSLVNPGPAMASHEDDDDKFFPQSGVLIFGKQGAGANDVAYENVMITDEEEIRTTNPVATEQYGSVSTNLQAGNAQAATADVN

SEQ ID NO: 5709 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTTPNENNNSDFSWTGATKYHLNGRDSLVNPGPAMASHRDDEDKFFPQSGVLIFGKQDAKRANVAVEEVMITDEEEIRTTNPVATEQYGSVSTNLQAGNAQAATADVN

SEQ ID NO: 5710 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 5711 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNVTNSKLGFSQAGASDIRDQSRNWLPGPCYRQQRVSKQDTDNNNSEFSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5712 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAARNGAAFGTVD

SEQ ID NO: 5713 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNTSTSDVEIDGVMITDEEEIRTTNPVATEQYGSVSTNLQRGNRQAATADVN

SEQ ID NO: 5714 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5715 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSEAGIHTQSQLLFSQAGASDIRDQSRNWLPGPCYRQQRVSKQSDRNNNSEFSWTGATKYHLNGRDSLVNPGPAMASHKDDEDKFFPQSGVLIFGKQNAGATDVDIGSVMITDEEEIRTTNPVATEQYGSVSTNLQAGNAQAATADVN

SEQ ID NO: 5716 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGQSPAADGAVT

SEQ ID NO: 5717 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSGLRFSQAGASDIRDQSRNWLPGPCYRQQRVSKTDGENNNSDFSWTGATKYHLNGRDSLVNPGPAMASHKDDDGKFFPQSGVLIFGKQGATGTNIDFERVMITDEEEIRTTNPVATEQYGSVSTNLQAGNAQAATADVN

SEQ ID NO: 5718 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQSSERANVDIEGVMITDEEEIRTTNPVATEQYGSVSTNLQAGNAQAATADVN

SEQ ID NO: 5719 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAERATAAANNVE

SEQ ID NO: 5720 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQTGPTTLSQLRFSQAGASDIRDQSRNWLPGPCYRQQRVSTQPARNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5721 - protein, 334 aa, Artificial Sequence; identical to SEQ ID NO: 2792
  Synthetic

SEQ ID NO: 5722 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 5723 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHHGQAASGGVH

SEQ ID NO: 5724 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGASESNIDIDGVMITDEEEIRTTNPVATEQYGSVSTNLQAGNAQAATADVN

SEQ ID NO: 5725 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5726 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTRAGSQTLSALGFSQAGASDIRDQSRNWLPGPCYRQQRVSKTSADNNNSNFSWTGATKYHLNGRDSLVNPGPAMASHRDDEDKFFPQSGVLIFGKQGAGTSDIAIDRVMITDEEEIRTTNPVATEQYGSVSTNLQAGNAQAATADVN

SEQ ID NO: 5727 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQEGRSQAAFAEVH

SEQ ID NO: 5728 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDADTTNTEIEHVMITDEEEIRTTNPVATEQYGSVSTNLQAGNAQAATADVN

SEQ ID NO: 5729 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGTGPMTKSDLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGPNNAAAYREVQ

SEQ ID NO: 5730 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQANSNPAASDSVQ

SEQ ID NO: 5731 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 5732 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGAGKTNIAIGQVMITDEEEIRTTNPVATEQYGSVSTNLQAGNAQAATADVN

SEQ ID NO: 5733 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDGGGSNVDIEGVMITDEEEIRTTNPVATEQYGSVSTNLQAGNAQAATADVN

SEQ ID NO: 5734 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRNTAANSTVA

SEQ ID NO: 5735 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGASGSMTNSGLRFSQAGASDIRDQSRNWLPGPCYRQQRVSKTDGENNNSDFSWTGATKYHLNGRDSLVNPGPAMASHKDDEEKFFPQSGVLIFGKESSGANNVEVDGVMITDEEEIRTTNPVATEQYGSVSTNLQAGNAQAATADVN

SEQ ID NO: 5736 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLGFSQAGASDIRDQSRNWLPGPCYRQQRVSKQPGDNNNSDFSWTGATKYHLNGRDSLVNPGPAMASHKDDDEKFFPQSGVLIFGKQGSEKTNVDIEKVMITDEEEIRTTNPVATEQYGSVSTNLQRGNAQAATADVN

SEQ ID NO: 5737 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAQRDHAASEAVH

SEQ ID NO: 5738 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGNVTKSQLGFSQAGASDIRDQSRNWLPGPCYRQQRVSTTYNHNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5739 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5740 - protein, 334 aa, Artificial Sequence; identical to SEQ ID NO: 4134
  Synthetic

SEQ ID NO: 5741 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRKNPAAVSDVE

SEQ ID NO: 5742 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQGSEKTNVDIEKVMITDEEEIRTTNPVATEQYGSVSTNLQAGNAQAATADVN

SEQ ID NO: 5743 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGNPTHSDLRFSQAGASDIRDQSRNWLPGPCYRQQRVSKTYNDNNNSEFSWTGATTYHLNGRDSLVNPGPAMASHKDDDERFFPQSGVLIFGKENAGRADVAFDKVMITDEEEIRTTNPVATEQYGSVSTNLQAGNAQAATADVN

SEQ ID NO: 5744 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDDNNNSDFSWPGATKYHLNGRDSLVNPGPAMASHKDDAEKFFPQSGVLIFGKQGSEKTNVDIEKVMITDEEEIRTTNPVATEQYGSVSTNLQRGNRQAATADVN

SEQ ID NO: 5745 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSKTDGENNNSDFSWTGATKYHLNGRDSLVNPGPAMASHKDDEEKFFPQSGVLIFGKEGSGKTDVAVGEVMITDEEEIRTTNPVATEQYGSVSTNLQAGNAQAATADVN

SEQ ID NO: 5746 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPAGNNNSEFSWTGATKYHLNGRDSLVNPGPAMASHKDDDDRFFPQSGVLIFGKENGGRTNIEIESVMITDEEEIRTTNPVATEQYGSVSTNLQAGNAQAATADVN

SEQ ID NO: 5747 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGNVTLSRLGFSQAGASDIRDQSRNWLPGPCYRQQRVSKTSADNNNSNFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5748 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSTQSTHNNNSDFSWTGATKYHLNGRDSLVNPGPAMASHRDDADSFFPQSGVLIFGKQGSEKTNVDIEKVMITDEEEIRTTNPVATEQYGSVSTNLQAGNAQAATADVN

SEQ ID NO: 5749 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5750 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQDATKTNVAIGGVMITDEEEIRTTNPVATEQYGSVSTNLQAGNAQAATADVN

SEQ ID NO: 5751 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGSKSNIAIDQVMITDEEEIRTTNPVATEQYGSVSTNLQAGNAQAATADVN

SEQ ID NO: 5752 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRQGGAASAVVE

SEQ ID NO: 5753 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPHDDNNNSDFSWTGATTYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 5754 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESARENNAEIDEVMITDEEEIRTTNPVATEQYGSVSTNLQAGNAQAATADVN

SEQ ID NO: 5755 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKQGSEKTNVDIEKVMITDEEEIRTTNPVATEQYGSVSTNLQAGNAQAATADVN

SEQ ID NO: 5756 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSTKDDRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5757 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQKERTPAAADTVN

SEQ ID NO: 5758 - protein, 334 aa, Artificial Sequence
  Synthetic
STGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGIITPSDLRFSQAGASDIRDQSRNWLPGPCYRQQRVSKTHGDNNNSNFSWTGATKYHLNGRDSLVNPGPAMASHRDDDEKFFPQSGVLIFGKQGASETNVEIDKVMITDEEEIRTTNPVATEQYGSVSTNLQAGNAQAATADVN

SEQ ID NO: 5759 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQGGSTTQSRLRFSQAGASDIRDQSRNWLPGPCYRQQRVSKTDGENNNSDFSWTGATKYHLNGRDSLVNPGPAMASHKDDDDRFFPQSGVLIFGKQNAGKDDVDIDQVMITDEEEIRTTNPVATEQYGSVSTNLQAGNAQAATADVN

SEQ ID NO: 5760 - protein, 334 aa, Artificial Sequence; identical to SEQ ID NO: 740
  Synthetic

SEQ ID NO: 5761 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGTQTTSTLGFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5762 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSTTPADNNNSDFSWTGATKYHLNGRDSLVNPGPAMASHKDDDDRFFPQSGVLIFGKEGSGKANVEIGRVMITDEEEIRTTNPVATEQYGSVSTNLQAGNAQAATADVN

SEQ ID NO: 5763 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKTPNDNNNSNFSWTGATKYHLNGRDSLVNPGPAMASHKDDDEKFFPQSGVLIFGKEGSEKTNVDIEKVMITDEEEIRTTNPVATEQYGSVSTNLQAGNAQAATADVN

SEQ ID NO: 5764 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGHTTISALRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5765 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGIDTKSRLVFSQAGASDIRDQSRNWLPGPCYRQQRVSKTSADNNNSEYSWTGATKYHLNGRDSLVNPGPAMASHKDDEEKFFPQSGVLIFGKQGAGKDDVDIGGVMITDEEEIRTTNPVATEQYGSVSTNLQAGNAQAATADVN

SEQ ID NO: 5766 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGGTDNVDIDRVMITDEEEIRTTNPVATEQYGSVSTNLQAGNAQAATADVN

SEQ ID NO: 5767 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKPPNGNNNSEFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5768 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 5769 - protein, 334 aa, Artificial Sequence; identical to SEQ ID NO: 1919
  Synthetic

SEQ ID NO: 5770 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGSATNSRLRFSQAGASDIRDQSRNWLPGPCYRQQRVSTTPADNNNSDFSWTGATKYHLNGRDSLVNPGPAMASHKDDDEKFFPQSGVLIFGKEGTTGTDAEIDNVMITDEEEIRTTNPVATEQYGSVSTNLQAGNAQAATADVN

SEQ ID NO: 5771 - protein, 334 aa, Artificial Sequence; identical to SEQ ID NO: 453
  Synthetic

SEQ ID NO: 5772 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5773 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGPSGTKTLSRLGFSQAGASDIRDQSRNWLPGPCYRQQRVSTKDDRNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5774 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGSGKDNVEVGQVMITDEEEIRTTNPVATEQYGSVSTNLQAGNAQAATADVN

SEQ ID NO: 5775 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKQPSENNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5776 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGTTTKSALRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5777 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSSGRATQSRLRFSQAGASDIRDQSRNWLPGPCYRQQRVSTTPADNNNSDFSWTGATKYHLNGRDSLVNPGPAMASHKDDDEKFFPQSGVLIFGKEGAGKDDADIERVMITDEEEIRTTNPVATEQYGSVSTNLQAGNAQAATADVN

SEQ ID NO: 5778 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKQNGGKSNVGIESVMITDEEEIRTTNPVATEQYGSVSTNLQAGNAQAATADVN

SEQ ID NO: 5779 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEDSAKGNTDIDNVMITDEEEIRTTNPVATEQYGSVSTNLQAGNAQAATADVN

SEQ ID NO: 5780 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDSEKSNVAIGGVMITDEEEIRTTNPVATEQYGSVSTNLQAGNAQAATADVN

SEQ ID NO: 5781 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNVTQSGLMFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5782 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 5783 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSNGNNNSNFSWTGATTYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 5784 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDNEKFFPQSGVLIFGKEGAGKTNIAVDRVMITDEEEIRTTNPVATEQYGSVSTNLQAGNAQAATADVN

SEQ ID NO: 5785 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNNGAAYAGVD

SEQ ID NO: 5786 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDGAGGDVAIEQVMITDEEEIRTTNPVATEQYGSVSTNLQAGNAQAATADVN

SEQ ID NO: 5787 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5788 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPNGTAASTTVA

SEQ ID NO: 5789 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPSENNNSDFSWTGATKYHLNGRDSLVNPGPAMASHKDDAGRFFPQSGVLIFGKEDSAKANTDIDRVMITDEEEIRTTNPVATEQYGSVSTNLQAGNAQAATADVN

SEQ ID NO: 5790 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPNGAAAVQEVN

SEQ ID NO: 5791 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGAGKDNVEIGGVMITDEEEIRTTNPVATEQYGSVSTNLQAGNAQAATADVN

SEQ ID NO: 5792 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKQDAGKANIDIDGVMITDEEEIRTTNPVATEQYGSVSTNLQAGNAQAATADVN

SEQ ID NO: 5793 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLMFSQAGASDIRDQSRNWLPGPCYRQQRVSTQSTGNNNSEYSWTGATKYHLNGRDSLVNPGPAMASHKDDEEKFFPQSGVLIFGKEGSKKGDADIESVMITDEEEIRTTNPVATEQYGSVSTNLQAGNAQAATADVN

SEQ ID NO: 5794 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLLFSQAGASDIRDQSRNWLPGPCYRQQRVSKQSSDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5795 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQNSAGNDAAVDEVMITDEEEIRTTNPVATEQYGSVSTNLQAGNAQAATADVN

SEQ ID NO: 5796 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGAGKTDVAIGRVMITDEEEIRTTNPVATEQYGSVSTNLQAGNAQAATADVN

SEQ ID NO: 5797 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSTQYDRNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5798 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGRFFPQSGVLIFGKQNSNRNNVDIEGVMITDEEEIRTTNPVATEQYGSVSTNLQAGNAQAATADVN

SEQ ID NO: 5799 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSTKDDRNNNSDFSWTGATKYHLNGRDSLVNPGPAMASHKDDDDRFFPQSGVLIFGKQGAGKTDVAIGRVMITDEEEIRTTNPVATEQYGSVSTNLQAGNAQAATADVN

SEQ ID NO: 5800 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKSKAAAAVASVD

SEQ ID NO: 5801 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5802 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTKTNSSLSFSQAGASDIRDQSRNWLPGPCYRQQRVSKTAADNNNSDFSWTGATKYHLNGRDSLVNPGPAMASHKDDEEKFFPQSGVLIFGKQGSEKTNVDIEKVMITDEEEIRTTNPVATEQYGSVSTNLQANRTAAADKAVN

SEQ ID NO: 5803 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTRGPAADRIVE

SEQ ID NO: 5804 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHRDDAGKFFPQSGVLIFGKQSTGADNVDIEQVMITDEEEIRTTNPVATEQYGSVSTNLQAGNAQAATADVN

SEQ ID NO: 5805 - protein, 334 aa, Artificial Sequence; identical to SEQ ID NO: 3674
  Synthetic

SEQ ID NO: 5806 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5807 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 5808 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTDNNNSNFSWTGATTYHLNGRDSLVNPGPAMASHKDDADRFFPQSGVLIFGKEGSRRDNAAIEHVMITDEEEIRTTNPVATEQYGSVSTNLQAGNAQAATADVN

SEQ ID NO: 5809 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRETLSRLKFSQAGASDIRDQSRNWLPGPCYRQQRVSKQPNDNNNSEFSWTGATTYHLNGRDSLVNPGPAMASHKDDNEKFFPQSGVLIFGKESGGKGNVEIEQVMITDEEEIRTTNPVATEQYGSVSTNLQAGNAQAATADVN

SEQ ID NO: 5810 - protein, 334 aa, Artificial Sequence; identical to SEQ ID NO: 3116
  Synthetic

SEQ ID NO: 5811 - protein, 334 aa, Artificial Sequence; identical to SEQ ID NO: 338
  Synthetic

SEQ ID NO: 5812 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQHTGNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5813 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQDADNNNSDFSWPGATKYHLNGRDSLVNPGPAMASHGDDKEKFFPQSGVLIFGKEGGGKTNVDFDKVMITDEEEIRTTNPVATEQYGSVSTNLQAGNAQAATADVN

SEQ ID NO: 5814 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQSAKAANAAIDEVMITDEEEIRTTNPVATEQYGSVSTNLQAGNAQAATADVN

SEQ ID NO: 5815 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSERAGAAYQDVQ

SEQ ID NO: 5816 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNGGSPTISNLRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQRGNRQAATADVN

SEQ ID NO: 5817 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5818 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTHSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDQRNSAAARNVT

SEQ ID NO: 5819 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGTGTNADIGNVMITDEEEIRTTNPVATEQYGSVSTNLQAGNAQAATADVN

SEQ ID NO: 5820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTKATDNNNSNFSWTGATTYHLNGRDSLVNPGPAMASHKDDEEKFFPQSGVLIFGKQSGRKNNTDIGDVMITDEEEIRTTNPVATEQYGSVSTNLQAGNAQAATADVN

SEQ ID NO: 5821 - protein, 334 aa, Artificial Sequence; identical to SEQ ID NO: 597
  Synthetic

SEQ ID NO: 5822 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGHLTKSKLSFSQAGASDIRDQSRNWLPGPCYRQQRVSKTSADNNNSEFSWTGATTYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5823 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKTAADNNNSDFSWTGATKYHLNGRDSLVNPGPAMASHKDDDGKFFPQSGVLIFGKESGGKSNVEIGDVMITDEEEIRTTNPVATEQYGSVSTNLQAGNAQAATADVN

SEQ ID NO: 5824 - protein, 334 aa, Artificial Sequence; identical to SEQ ID NO: 2148
  Synthetic

SEQ ID NO: 5825 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPAGRETISRLQFSQAGASDIRDQSRNWLPGPCYRQQRVSKQSSDNNNSEFSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 5826 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSKFSWPGATTYHLNGRDSLVNPGPAMASHRDDEDKFFPQSGVLIFGKQSAKAANAAIDEVMITDEEEIRTTNPVATEQYGSVSTNLQAGNAQAATADVN

SEQ ID NO: 5827 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSNFSWTGATKYHLNGRDSLVNPGPAMASHKDDNDRFFPQSGVLIFGKQGSEKTNVDIEKVMITDEEEIRTTNPVATEQYGSVSTNLQRGNRQAATADVN

SEQ ID NO: 5828 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNVTQSKLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5829 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5830 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKEGGAEGDVDFDGVMITDEEEIRTTNPVATEQYGSVSTNLQRGNRQAATADVN

SEQ ID NO: 5831 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGTAETNVEIEEVMITDEEEIRTTNPVATEQYGSVSTNLQAGNAQAATADVN

SEQ ID NO: 5832 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPGGNNNSEYSWTGATKYHLNGRDSLVNPGPAMASHKDDDDRFFPQSGVLIFGKEGSAANDVDIGGVMITDEEEIRTTNPVATEQYGSVSTNLQAGNAQAATADVN

SEQ ID NO: 5833 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGPQTTSTLRFSQAGASDIRDQSRNWLPGPCYRQQRVSKTDGENNNSDFSWTGATKYHLNGRDSLVNPGPAMASHKDDEEKFFPQSGVLIFGKEGARRANAEIDKVMITDEEEIRTTNPVATEQYGSVSTNLQAGNAQAATADVN

SEQ ID NO: 5834 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGSNTMSRLKFSQAGASDIRDQSRNWLPGPCYRQQRVSKTSGDNNNSDFSWTGATKYHLNGRDSLVNPGPAMASHGDDADRFFPQSGVLIFGKQNAAKANVDIGDVMITDEEEIRTTNPVATEQYGSVSTNLQAGNAQAATADVN

SEQ ID NO: 5835 - protein, 334 aa, Artificial Sequence
  Synthetic
QTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRVTLSNLGFSQAGASDIRDQSRNWLPGPCYRQQRVSKVSADNNNSEFSWTGATKYHLNGRDSLVNPGPAMASHKDDEEKFFPQSGVLIFGKEGSAASNVDIGGVMITDEEEIRTTNPVATEQYGSVSTNLQAGNAQAATADVN

SEQ ID NO: 5836 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNIDIGKVMITDEEEIRTTNPVATEQYGSVSTNLQAGNAQAATADVN

SEQ ID NO: 5837 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5838 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRSPAATADVA

SEQ ID NO: 5839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 5840 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 5841 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLRFSQAGASDIRDQSRNWLPGPCYRQQRVSKVSADNNNSEFSWTGATKYHLNGRDSLVNPGPAMASHKDDEEKFFPQSGVLIFGKENGGTNNVEIGNVMITDEEEIRTTNPVATEQYGSVSTNLQAGNAQAATADVN

SEQ ID NO: 5842 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRNNAAAFAGVN

SEQ ID NO: 5843 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGINTTSRLHFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5844 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5845 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQDSERNDVAIESVMITDEEEIRTTNPVATEQYGSVSTNLQAGNAQAATADVN

SEQ ID NO: 5846 - protein, 334 aa, Artificial Sequence; identical to SEQ ID NO: 3390
  Synthetic

SEQ ID NO: 5847 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDAGKSNADIDRVMITDEEEIRTTNPVATEQYGSVSTNLQAGNAQAATADVN

SEQ ID NO: 5848 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 5849 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTTGILTTSTLKFSQAGASDIRDQSRNWLPGPCYRQQRVSKQPNQNNNSDFSWTGATKYHLNGRDSLVNPGPAMASHRDDDDKFFPQSGVLIFGKEGARKTDAEIDNVMITDEEEIRTTNPVATEQYGSVSTNLQAGNAQAATADVN

SEQ ID NO: 5850 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKESGSESNIAIEDVMITDEEEIRTTNPVATEQYGSVSTNLQAGNAQAATADVN

SEQ ID NO: 5851 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKTATRNNNSDFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 5852 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPGGRQTTSELRFSQAGASDIRDQSRNWLPGPCYRQQRVSKQDAENNNSEFSWPGATKYHLNGRDSLVNPGPAMASHKDDEERFFPQSGVLIFGKQGSEKTNVDIEKVMITDEEEIRTTNPVATEQYGSVSTNLQAGNAQAATADVN

SEQ ID NO: 5853 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKQSGSKNNVAVEDVMITDEEEIRTTNPVATEQYGSVSTNLQAGNAQAATADVN

SEQ ID NO: 5854 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNANGGHLTKSKLSFSQAGASDIRDQSRNWLPGPCYRQQRVSKTSADNNNSDFSWTGATTYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 5855 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQDAENNNSEFSWPGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 5856 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRSGAAATRSVA

SEQ ID NO: 5857 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 5858 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGASGSMTNSGLRFSQAGASDIRDQSRNWLPGPCYRQQRVSKTDGENNNSDFSWTGATKYHLNGRDSLVNPGPAMASHKDDEEKFFPQSGVLIFGKESSGANNVEVDGVMITDEEEIRTTNPVATEQYGSVSTNLQAGNAQAATADVN

SEQ ID NO: 5859 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEGTSGGDVEIEQVMITDEEEIRTTNPVATEQYGSVSTNLQAGNAQAATADVN

SEQ ID NO: 5860 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5861 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 5862 - protein, 334 aa, Artificial Sequence; identical to SEQ ID NO: 1193
  Synthetic

SEQ ID NO: 5863 - protein, 334 aa, Artificial Sequence
  Synthetic
KSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNGGHVTHSGLRFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 5864 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKESGSTTDAAIGQVMITDEEEIRTTNPVATEQYGSVSTNLQAGNAQAATADVN

SEQ ID NO: 5865 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 5866 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGLNTISGLRFSQAGASDIRDQSRNWLPGPCYRQQRVSTKPDRNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGHDQAAYHSVQ

SEQ ID NO: 5868 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDKRTPAADRRVE

SEQ ID NO: 5869 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSSATGDTEIDGVMITDEEEIRTTNPVATEQYGSVSTNLQAGNAQAATADVN

SEQ ID NO: 5870 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5871 - protein, 334 aa, Artificial Sequence
  Synthetic
QSGSSNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5872 - protein, 334 aa, Artificial Sequence; identical to SEQ ID NO: 1605
  Synthetic

SEQ ID NO: 5873 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKTSADNNNSNFSWTGATKYHLNGRDSLVNPGPAMASHRDDEDKFFPQSGVLIFGKQGASGDNVDIGRVMITDEEEIRTTNPVATEQYGSVSTNLQAGNAQAATADVN

SEQ ID NO: 5874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDADRFFPQSGVLIFGKEGSGRTNIAFDGVMITDEEEIRTTNPVATEQYGSVSTNLQAGNAQAATADVN

SEQ ID NO: 5875 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5876 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHEDDAEKFFPQSGVLIFGKEGSGKSDAAIGDVMITDEEEIRTTNPVATEQYGSVSTNLQAGNAQAATADVN

SEQ ID NO: 5877 - protein, 334 aa, Artificial Sequence; identical to SEQ ID NO: 772
  Synthetic

SEQ ID NO: 5878 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAAQSQAANTAVT

SEQ ID NO: 5879 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRSGRAATEDVP

SEQ ID NO: 5880 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKEGAGANDVAVEHVMITDEEEIRTTNPVATEQYGSVSTNLQAGNAQAATADVN

SEQ ID NO: 5881 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 5882 - protein, 334 aa, Artificial Sequence; identical to SEQ ID NO: 471
  Synthetic

SEQ ID NO: 5883 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRDPAANNGVN

SEQ ID NO: 5884 - protein, 334 aa, Artificial Sequence; identical to SEQ ID NO: 1239
  Synthetic

SEQ ID NO: 5885 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGASTDDADVGEVMITDEEEIRTTNPVATEQYGSVSTNLQAGNAQAATADVN

SEQ ID NO: 5886 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5887 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDEDKFFPQSGVLIFGKEGAGKGDIAYGDVMITDEEEIRTTNPVATEQYGSVSTNLQAGNAQAATADVN

SEQ ID NO: 5888 - protein, 334 aa, Artificial Sequence; identical to SEQ ID NO: 3256
  Synthetic

SEQ ID NO: 5889 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKESGTKANADIGHVMITDEEEIRTTNPVATEQYGSVSTNLQAGNAQAATADVN

SEQ ID NO: 5890 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRHDGAASHMVE

SEQ ID NO: 5891 - protein, 334 aa, Artificial Sequence; identical to SEQ ID NO: 2415
  Synthetic

SEQ ID NO: 5892 - protein, 334 aa, Artificial Sequence; identical to SEQ ID NO: 1123
  Synthetic

SEQ ID NO: 5893 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPDRNNNSEFSWTGATTYHLNGRDSLVNPGPAMASHKDDEEKFFPQSGVLIFGKQGTTGNDVDVDGVMITDEEEIRTTNPVATEQYGSVSTNLQAGNAQAATADVN

SEQ ID NO: 5894 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARNPAAATAVE

SEQ ID NO: 5895 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDTGTLTQSRLRFSQAGASDIRDQSRNWLPGPCYRQQRVSKTHGDNNNSNFSWTGATTYHLNGRDSLVNPGPAMASHKDDDEKFFPQSGVLIFGKESGGGGDTDVEGVMITDEEEIRTTNPVATEQYGSVSTNLQAGNAQAATADVN

SEQ ID NO: 5896 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQDTDNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5897 - protein, 334 aa, Artificial Sequence; identical to SEQ ID NO: 125
  Synthetic

SEQ ID NO: 5898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSSRSGAAAGNVT

SEQ ID NO: 5899 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDKAGIKTKSSLGFSQAGASDIRDQSRNWLPGPCYRQQRVSKQPNDNNNSEFSWTGATTYHLNGRDSLVNPGPAMASHKDDNEKFFPQSGVLIFGKEGTAGTDIDIDKVMITDEEEIRTTNPVATEQYGSVSTNLQAGNAQAATADVN

SEQ ID NO: 5900 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGRVTTSRLLFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 5901 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGRMTTSRLEFSQAGASDIRDQSRNWLPGPCYRQQRVSKTHGDNNNSNFSWTGATTYHLNGRDSLVNPGPAMASHKDDAEKFFPQSGVLIFGKEGAGKTNIAIDDVMITDEEEIRTTNPVATEQYGSVSTNLQAGNAQAATADVN

SEQ ID NO: 5902 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 5903 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPHDDNNNSDFSWTGATTYHLNGRDSLVNPGPAMASHKDDDGKFFPQSGVLIFGKQNTGGGNVDIDGVMITDEEEIRTTNPVATEQYGSVSTNLQAGNAQAATADVN

SEQ ID NO: 5904 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDAEKFFPQSGVLIFGKEGSAKADADIGDVMITDEEEIRTTNPVATEQYGSVSTNLQAGNAQAATADVN

SEQ ID NO: 5905 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDADRFFPQSGVLIFGKEGGTEGDIAIEDVMITDEEEIRTTNPVATEQYGSVSTNLQAGNAQAATADVN

SEQ ID NO: 5906 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGATGLATMSHLRFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 5907 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDAGRFFPQSGVLIFGKQGSEKTNVDIEKVMITDEEEIRTTNPVATEQYGSVSTNLQAGNAQAATADVN

SEQ ID NO: 5908 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHGGNKTISNLRFSQAGASDIRDQSRNWLPGPCYRQQRVSKTPSHNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 5909 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKQPNDNNNSEFSWTGATTYHLNGRDSLVNPGPAMASHKDDNEKFFPQSGVLIFGKEGAGKANVEFERVMITDEEEIRTTNPVATEQYGSVSTNLQAGNAQAATADVN

SEQ ID NO: 5910 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGTTTQSHLVFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5911 - protein, 334 aa, Artificial Sequence; identical to SEQ ID NO: 2492
  Synthetic

SEQ ID NO: 5912 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTAAANVDVGEVMITDEEEIRTTNPVATEQYGSVSTNLQAGNAQAATADVN

SEQ ID NO: 5913 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHEDDADKFFPQSGVLIFGKQGSEKTNVDIEKVMITDEEEIRTTNPVATEQYGSVSTNLQAGNAQAATADVN

SEQ ID NO: 5914 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPQGRAASRDVA

SEQ ID NO: 5915 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSENNNSDFSWTGATKYHLNGRDSLVNPGPAMASHKDDAGRFFPQSGVLIFGKEDSAKANTDIDRVMITDEEEIRTTNPVATEQYGSVSTNLQAGNAQAATADVN

SEQ ID NO: 5916 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDGKFFPQSGVLIFGKQGTGKANIDIDRVMITDEEEIRTTNPVATEQYGSVSTNLQAGNAQAATADVN

SEQ ID NO: 5917 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 5918 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 5919 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKAGPDTKSALRFSQAGASDIRDQSRNWLPGPCYRQQRVSKTAARNNNSDFSWTGATKYHLNGRDSLVNPGPAMASHKDDDEKFFPQSGVLIFGKQDAGKGDVAYEQVMITDEEEIRTTNPVATEQYGSVSTNLQAGNAQAATADVN

SEQ ID NO: 5920 - protein, 334 aa, Artificial Sequence; identical to SEQ ID NO: 1189
  Synthetic

SEQ ID NO: 5921 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRHGGAAFTEVT

SEQ ID NO: 5922 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTRTTAAVTNVH

SEQ ID NO: 5923 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRPRDAAAVAIVN

SEQ ID NO: 5924 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSNRAGAANAGVT

SEQ ID NO: 5925 - protein, 334 aa, Artificial Sequence; identical to SEQ ID NO: 99
  Synthetic

SEQ ID NO: 5926 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGTGKNNIAFEDVMITDEEEIRTTNPVATEQYGSVSTNLQAGNAQAATADVN

SEQ ID NO: 5927 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRAGLATNSKLEFSQAGASDIRDQSRNWLPGPCYRQQRVSKTDGENNNSDFSWTGATKYHLNGRDSLVNPGPAMASHKDDEDKFFPQSGVLIFGKQGAGKNNAAIGQVMITDEEEIRTTNPVATEQYGSVSTNLQAGNAQAATADVN

SEQ ID NO: 5928 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKENAGASDIAIDHVMITDEEEIRTTNPVATEQYGSVSTNLQAGNAQAATADVN

SEQ ID NO: 5929 - protein, 334 aa, Artificial Sequence; identical to SEQ ID NO: 851
  Synthetic

SEQ ID NO: 5930 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGRAPAAFSEVN

SEQ ID NO: 5931 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSNENNNSEFSWTGATKYHLNGRDSLVNPGPAMASHRDDNEKFFPQSGVLIFGKEGAKGSDADFDNVMITDEEEIRTTNPVATEQYGSVSTNLQAGNAQAATADVN

SEQ ID NO: 5932 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDEGKFFPQSGVLIFGKQGASTDDADVGEVMITDEEEIRTTNPVATEQYGSVSTNLQAGNAQAATADVN

SEQ ID NO: 5933 - protein, 334 aa, Artificial Sequence; identical to SEQ ID NO: 1776
  Synthetic

SEQ ID NO: 5934 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKESANKTNIDIEHVMITDEEEIRTTNPVATEQYGSVSTNLQAGNAQAATADVN

SEQ ID NO: 5935 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESGNRTDVEVEDVMITDEEEIRTTNPVATEQYGSVSTNLQAGNAQAATADVN

SEQ ID NO: 5936 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQGTRGTAAADAVQ

SEQ ID NO: 5937 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDDDRFFPQSGVLIFGKQDSEKANVAVDDVMITDEEEIRTTNPVATEQYGSVSTNLQAGNAQAATADVN

SEQ ID NO: 5938 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGITTPSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIGEVMITDEEEIRTTNPVATEQYGSVSTNLQAGNAQAATADVN

SEQ ID NO: 5939 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQSSGKSNIAIEGVMITDEEEIRTTNPVATEQYGSVSTNLQAGNAQAATADVN

SEQ ID NO: 5940 - protein, 334 aa, Artificial Sequence; identical to SEQ ID NO: 854
  Synthetic

SEQ ID NO: 5941 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNAAASADVK

SEQ ID NO: 5942 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATTYHLNGRDSLVNPGPAMASHGDDTDRFFPQSGVLIFGKEGAGGNNVEIDDVMITDEEEIRTTNPVATEQYGSVSTNLQRGNRQAATADVN

SEQ ID NO: 5943 - protein, 334 aa, Artificial Sequence; identical to SEQ ID NO: 508
  Synthetic

SEQ ID NO: 5944 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKNTGAADKGVQ

SEQ ID NO: 5945 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTNESDVDIEKVMITDEEEIRTTNPVATEQYGSVSTNLQAGNAQAATADVN

SEQ ID NO: 5946 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDTAKANAAIGEVMITDEEEIRTTNPVATEQYGSVSTNLQAGNAQAATADVN

SEQ ID NO: 5947 - protein, 334 aa, Artificial Sequence; identical to SEQ ID NO: 2651
  Synthetic

SEQ ID NO: 5948 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRNTTSSLGFSQAGASDIRDQSRNWLPGPCYRQQRVSKTHGDNNNSNFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 5949 - protein, 334 aa, Artificial Sequence; identical to SEQ ID NO: 4063
  Synthetic

SEQ ID NO: 5950 - protein, 334 aa, Artificial Sequence; identical to SEQ ID NO: 158
  Synthetic

SEQ ID NO: 5951 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5952 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGAGKTDVAIGRVMITDEEEIRTTNPVATEQYGSVSTNLQAGNAQAATADVN

SEQ ID NO: 5953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDNGRFFPQSGVLIFGKQGASAADVEIEDVMITDEEEIRTTNPVATEQYGSVSTNLQAGNAQAATADVN

SEQ ID NO: 5954 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGGGNKTTSRLLFSQAGASDIRDQSRNWLPGPCYRQQRVSKQSDRNNNSEFSWTGATKYHLNGRDSLVNPGPAMASHKDDDDRFFPQSGVLIFGKEDGGKSNVEIDRVMITDEEEIRTTNPVATEQYGSVSTNLQAGNAQAATADVN

SEQ ID NO: 5955 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSEFSWTGATTYHLNGRDSLVNPGPAMASHKDDDDRFFPQSGVLIFGKENAKTTDAEFGQVMITDEEEIRTTNPVATEQYGSVSTNLQAGNAQAATADVN

SEQ ID NO: 5956 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5957 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDTGRFFPQSGVLIFGKQGSEKTNVDIEKVMITDEEEIRTTNPVATEQYGSVSTNLQAGNAQAATADVN

SEQ ID NO: 5958 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARSNRAAFDVVH

SEQ ID NO: 5959 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEDSAKGNTDIDNVMITDEEEIRTTNPVATEQYGSVSTNLQAGNAQAATADVN

SEQ ID NO: 5960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGATENNVEFDSVMITDEEEIRTTNPVATEQYGSVSTNLQAGNAQAATADVN

SEQ ID NO: 5961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARSSAAAVEMVE

SEQ ID NO: 5962 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQPGDNNNSNFSWTGATKYHLNGRDSLVNPGPAMASHKDDEEKFFPQSGVLIFGKEGTAKSNVEYEKVMITDEEEIRTTNPVATEQYGSVSTNLQAGNAQAATADVN

SEQ ID NO: 5963 - protein, 334 aa, Artificial Sequence; identical to SEQ ID NO: 193
  Synthetic

SEQ ID NO: 5964 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADKFFPQSGVLIFGKQGSEKTNVDIEKVMITDEEEIRTTNPVATEQYGSVSTNLQRGNRQAATADVN

SEQ ID NO: 5965 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGHTTPSELRFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 5966 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKSGPTTMSTLRFSQAGASDIRDQSRNWLPGPCYRQQRVSKQPNDNNNSEFSWTGATTYHLNGRDSLVNPGPAMASHKDDNEKFFPQSGVLIFGKESATGGNTDIGGVMITDEEEIRTTNPVATEQYGSVSTNLQAGNAQAATADVN

SEQ ID NO: 5967 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSEFSWTGATTYHLNGRDSLVNPGPAMASHKDDDDKFFPQSGVLIFGKQSAKAANAAIDEVMITDEEEIRTTNPVATEQYGSVSTNLQRGNRQAATADVN

SEQ ID NO: 5968 - protein, 334 aa, Artificial Sequence; identical to SEQ ID NO: 995
  Synthetic

SEQ ID NO: 5969 - protein, 334 aa, Artificial Sequence; identical to SEQ ID NO: 996
  Synthetic

SEQ ID NO: 5970 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQRGNRQAATADVN

SEQ ID NO: 5971 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 5972 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRAPAASETVQ

SEQ ID NO: 5973 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGITTKSRLQFSQAGASDIRDQSRNWLPGPCYRQQRVSKTDGENNNSDFSWTGATKYHLNGRDSLVNPGPAMASHKDDEEKFFPQSGVLIFGKEGAGAADADVDHVMITDEEEIRTTNPVATEQYGSVSTNLQAGNAQAATADVN

SEQ ID NO: 5974 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTYNDNNNSEFSWTGATTYHLNGRDSLVNPGPAMASHRDDDDRFFPQSGVLIFGKQSARTGDTAIEGVMITDEEEIRTTNPVATEQYGSVSTNLQAGNAQAATADVN

SEQ ID NO: 5975 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARSGSLTQSHLGFSQAGASDIRDQSRNWLPGPCYRQQRVSKTYNDNNNSEFSWTGATTYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 5976 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKEGATENNVEFDSVMITDEEEIRTTNPVATEQYGSVSTNLQAGNAQAATADVN

SEQ ID NO: 5977 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPNDNNNSEFSWTGATTYHLNGRDSLVNPGPAMASHKDDDDKFFPQSGVLIFGKQGTGASNVEVENVMITDEEEIRTTNPVATEQYGSVSTNLQAGNAQAATADVN

SEQ ID NO: 5978 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDGAGDNVEIERVMITDEEEIRTTNPVATEQYGSVSTNLQAGNAQAATADVN

SEQ ID NO: 5979 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGLQTHSRLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 5980 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARSSAATEIVK

SEQ ID NO: 5981 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGTPTHSTLKFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 5982 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSSDNNNSDFSWTGATKYHLNGRDSLVNPGPAMASHKDDDDKFFPQSGVLIFGKESSGKADVEFGEVMITDEEEIRTTNPVATEQYGSVSTNLQAGNAQAATADVN

SEQ ID NO: 5983 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 5984 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDDGNNNSNFSWPGATKYHLNGRDSLVNPGPAMASHRDDDDKFFPQSGVLIFGKENGKETNIDIDGVMITDEEEIRTTNPVATEQYGSVSTNLQAGNAQAATADVN

SEQ ID NO: 5985 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKKDDGNNNSNFSWTGATTYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 5986 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDDRNNNSDFSWTGATKYHLNGRDSLVNPGPAMASHKDDDDRFFPQSGVLIFGKEGTRKNNVDIEQVMITDEEEIRTTNPVATEQYGSVSTNLQAGNAQAATADVN

SEQ ID NO: 5987 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 5988 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGLDTPSDLRFSQAGASDIRDQSRNWLPGPCYRQQRVSKTPNDNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5989 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDAENNNSEFSWTGATKYHLNGRDSLVNPGPAMASHKDDNEKFFPQSGVLIFGKQGSEKTNVDIEKVMITDEEEIRTTNPVATEQYGSVSTNLQRGNRQAATADVN

SEQ ID NO: 5990 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTDGENNNSDFSWTGATKYHLNGRDSLVNPGPAMASHKDDDDRFFPQSGVLIFGKEGTGGSDVEIERVMITDEEEIRTTNPVATEQYGSVSTNLQAGNAQAATADVN

SEQ ID NO: 5991 - protein, 334 aa, Artificial Sequence; identical to SEQ ID NO: 435
  Synthetic

SEQ ID NO: 5992 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGSMTMSTLKFSQAGASDIRDQSRNWLPGPCYRQQRVSTKASGNNNSEFSWTGATKYHLNGRDSLVNPGPAMASHKDDDDRFFPQSGVLIFGKEGAGANDVAYENVMITDEEEIRTTNPVATEQYGSVSTNLQAGNAQAATADVN

SEQ ID NO: 5993 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDSNGNNIAIDKVMITDEEEIRTTNPVATEQYGSVSTNLQAGNAQAATADVN

SEQ ID NO: 5994 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 5995 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGRVTISGLRFSQAGASDIRDQSRNWLPGPCYRQQRVSKVSADNNNSEFSWTGATKYHLNGRDSLVNPGPAMASHRDDEEKFFPQSGVLIFGKESGGKGNVEIEQVMITDEEEIRTTNPVATEQYGSVSTNLQAGNAQAATADVN

SEQ ID NO: 5996 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKQHNQNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 5997 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTASDNNNSDFSWTGATKYHLNGRDSLVNPGPAMASHKDDNEKFFPQSGVLIFGKQGGTAGNVDVEGVMITDEEEIRTTNPVATEQYGSVSTNLQAGNAQAATADVN

SEQ ID NO: 5998 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKQSADNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 5999 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6000 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKQSDRNNNSEFSWTGATKYHLNGRDSLVNPGPAMASHKDDEDKFFPQSGVLIFGKEGTGANNAEIGEVMITDEEEIRTTNPVATEQYGSVSTNLQAGNAQAATADVN

SEQ ID NO: 6001 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQRGNRQAATADVN

SEQ ID NO: 6002 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPTGSVTQSHLRFSQAGASDIRDQSRNWLPGPCYRQQRVSKTSTENNNSEFSWTGATTYHLNGRDSLVNPGPAMASHKDDEEKFFPQSGVLIFGKEGAAASDAAYENVMITDEEEIRTTNPVATEQYGSVSTNLQAGNAQAATADVN

SEQ ID NO: 6003 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRAGAADTEVQ

SEQ ID NO: 6004 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTSGPAATQKVN

SEQ ID NO: 6005 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGIVTLSGLRFSQAGASDIRDQSRNWLPGPCYRQQRVSTKDDRNNNSDFSWTGATKYHLNGRDSLVNPGPAMASHKDDDDRFFPQSGVLIFGKEDAGRNDVAFDHVMITDEEEIRTTNPVATEQYGSVSTNLQAGNAQAATADVN

SEQ ID NO: 6006 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDEGRFFPQSGVLIFGKQSGSKNDIAIEDVMITDEEEIRTTNPVATEQYGSVSTNLQAGNAQAATADVN

SEQ ID NO: 6007 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGANRTDVDIDRVMITDEEEIRTTNPVATEQYGSVSTNLQAGNAQAATADVN

SEQ ID NO: 6008 - protein, 334 aa, Artificial Sequence; identical to SEQ ID NO: 1457
  Synthetic

SEQ ID NO: 6009 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHEDDTEKFFPQSGVLIFGKQGSEKTNVDIEKVMITDEEEIRTTNPVATEQYGSVSTNLQRGNRQAATADVN

SEQ ID NO: 6010 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTSGTDTISRLSFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6011 - protein, 334 aa, Artificial Sequence
  Synthetic
EAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDGAKTNVDVGRVMITDEEEIRTTNPVATEQYGSVSTNLQAGNAQAATADVN

SEQ ID NO: 6012 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIQTMSQLRFSQAGASDIRDQSRNWLPGPCYRQQRVSKQYSRNNNSNFSWTGATKYHLNGRDSLVNPGPAMASHRDDDEKFFPQSGVLIFGKEGAGKTDVAIGRVMITDEEEIRTTNPVATEQYGSVSTNLQAGNAQAATADVN

SEQ ID NO: 6013 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGNGANIDVEGVMITDEEEIRTTNPVATEQYGSVSTNLQAGNAQAATADVN

SEQ ID NO: 6014 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKQSGDNNNSNFSWTGATTYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 6015 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGGGATDVAVEEVMITDEEEIRTTNPVATEQYGSVSTNLQAGNAQAATADVN

SEQ ID NO: 6016 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRASAAVNVVP

SEQ ID NO: 6017 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKESAGAGNVAIGRVMITDEEEIRTTNPVATEQYGSVSTNLQAGNAQAATADVN

SEQ ID NO: 6018 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGPATKSALGFSQAGASDIRDQSRNWLPGPCYRQQRVSKVSADNNNSEFSWTGATKYHLNGRDSLVNPGPAMASHKDDEEKFFPQSGVLIFGKQDGGGNNVDIERVMITDEEEIRTTNPVATEQYGSVSTNLQAGNAQAATADVN

SEQ ID NO: 6019 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKESGGRANVEVESVMITDEEEIRTTNPVATEQYGSVSTNLQAGNAQAATADVN

SEQ ID NO: 6020 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDGKTGDVDVGEVMITDEEEIRTTNPVATEQYGSVSTNLQAGNAQAATADVN

SEQ ID NO: 6021 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGLNTLSDLRFSQAGASDIRDQSRNWLPGPCYRQQRVSKTHGDNNNSNFSWTGATTYHLNGRDSLVNPGPAMASHGDDKDKFFPQSGVLIFGKQGSEKTNVDIEKVMITDEEEIRTTNPVATEQYGSVSTNLQAGNAQAATADVN

SEQ ID NO: 6022 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKERSPAAIATVN

SEQ ID NO: 6023 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTHSTAAFETVD

SEQ ID NO: 6024 - protein, 334 aa, Artificial Sequence; identical to SEQ ID NO: 3098
  Synthetic

SEQ ID NO: 6025 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 6026 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQSSDNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6027 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKESTGTTNAAVEQVMITDEEEIRTTNPVATEQYGSVSTNLQAGNAQAATADVN

SEQ ID NO: 6028 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQSGSKNDIAIEDVMITDEEEIRTTNPVATEQYGSVSTNLQAGNAQAATADVN

SEQ ID NO: 6029 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTEHNPAAFRSVT

SEQ ID NO: 6030 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSTKPSDNNNSDFSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 6031 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNKTQSALGFSQAGASDIRDQSRNWLPGPCYRQQRVSTTPGGNNNSNFSWTGATKYHLNGRDSLVNPGPAMASHKDDDDKFFPQSGVLIFGKQSAKAANAAIDEVMITDEEEIRTTNPVATEQYGSVSTNLQAGNAQAATADVN

SEQ ID NO: 6032 - protein, 334 aa, Artificial Sequence; identical to SEQ ID NO: 810
  Synthetic

SEQ ID NO: 6033 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPSGNVTQSTLQFSQAGASDIRDQSRNWLPGPCYRQQRVSTQDGENNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6034 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGGAANDVDIEHVMITDEEEIRTTNPVATEQYGSVSTNLQAGNAQAATADVN

SEQ ID NO: 6035 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGHPTLSQLKFSQAGASDIRDQSRNWLPGPCYRQQRVSKKYTENNNSEFSWTGATKYHLNGRDSLVNPGPAMASHEDDTGRFFPQSGVLIFGKQGSEKTNVDIEKVMITDEEEIRTTNPVATEQYGSVSTNLQRGNRQAATADVN

SEQ ID NO: 6036 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTDATNVAVDQVMITDEEEIRTTNPVATEQYGSVSTNLQRGNRQAATADVN

SEQ ID NO: 6037 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDHTGTDTPSRLRFSQAGASDIRDQSRNWLPGPCYRQQRVSKTSNGNNNSEFSWTGATKYHLNGRDSLVNPGPAMASHRDDEDKFFPQSGVLIFGKEDARKDNVEVGEVMITDEEEIRTTNPVATEQYGSVSTNLQAGNAQAATADVN

SEQ ID NO: 6038 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6039 - protein, 334 aa, Artificial Sequence; identical to SEQ ID NO: 318
  Synthetic

SEQ ID NO: 6040 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHTGLKTNSRLGFSQAGASDIRDQSRNWLPGPCYRQQRVSKTYNDNNNSEFSWTGATTYHLNGRDSLVNPGPAMASHKDDDERFFPQSGVLIFGKQGTKKTNAEIEDVMITDEEEIRTTNPVATEQYGSVSTNLQAGNAQAATADVN

SEQ ID NO: 6041 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6042 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6043 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSAHNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6044 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSTQPGDNNNSNFSWTGATKYHLNGRDSLVNPGPAMASHRDDNDKFFPQSGVLIFGKQGSEKTNVDIEKVMITDEEEIRTTNPVATEQYGSVSTNLQAGNAQAATADVN

SEQ ID NO: 6045 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNEKFFPQSGVLIFGKQDTSANDTDIDGVMITDEEEIRTTNPVATEQYGSVSTNLQAGNAQAATADVN

SEQ ID NO: 6046 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSALGFSQAGASDIRDQSRNWLPGPCYRQQRVSTKATDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6047 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQADHTQAAVAAVQ

SEQ ID NO: 6048 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTTGTTTMSTLLFSQAGASDIRDQSRNWLPGPCYRQQRVSKKSTQNNNSEFSWTGATKYHLNGRDSLVNPGPAMASHKDDDDRFFPQSGVLIFGKQGSDKDNVEIEGVMITDEEEIRTTNPVATEQYGSVSTNLQAGNAQAATADVN

SEQ ID NO: 6049 - protein, 334 aa, Artificial Sequence; identical to SEQ ID NO: 3972
  Synthetic

SEQ ID NO: 6050 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6051 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKKDSRNNNSDFSWTGATKYHLNGRDSLVNPGPAMASHRDDDEKFFPQSGVLIFGKQSTAKTDADFDSVMITDEEEIRTTNPVATEQYGSVSTNLQAGNAQAATADVN

SEQ ID NO: 6052 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKENSKATDAEIEDVMITDEEEIRTTNPVATEQYGSVSTNLQAGNAQAATADVN

SEQ ID NO: 6053 - protein, 334 aa, Artificial Sequence
  Synthetic
HTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPTGNNNSNFSWTGATKYHLNGRDSLVNPGPAMASHRDDDGKFFPQSGVLIFGKQGAATNDAEFEEVMITDEEEIRTTNPVATEQYGSVSTNLQAGNAQAATADVN

SEQ ID NO: 6054 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6055 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTGRDGAAITGVT

SEQ ID NO: 6056 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGTITKSNLMFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6057 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6058 - protein, 334 aa, Artificial Sequence; identical to SEQ ID NO: 571
  Synthetic

SEQ ID NO: 6059 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSGGGDAAIEGVMITDEEEIRTTNPVATEQYGSVSTNLQAGNAQAATADVN

SEQ ID NO: 6060 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGSLTQSRLRFSQAGASDIRDQSRNWLPGPCYRQQRVSKTSADNNNSDFSWTGATTYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6061 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGGAASNAAFDEVMITDEEEIRTTNPVATEQYGSVSTNLQAGNAQAATADVN

SEQ ID NO: 6062 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDKAGIKTKSSLGFSQAGASDIRDQSRNWLPGPCYRQQRVSKTSADNNNSEYSWTGATKYHLNGRDSLVNPGPAMASHKDDDERFFPQSGVLIFGKQGTGKNNIAFEDVMITDEEEIRTTNPVATEQYGSVSTNLQAGNAQAATADVN

SEQ ID NO: 6063 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKASDNNNSNFSWTGATTYHLNGRDSLVNPGPAMASHEDDDDKFFPQSGVLIFGKQGSEKTNVDIEKVMITDEEEIRTTNPVATEQYGSVSTNLQRGNRQAATADVN

SEQ ID NO: 6064 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGITTKSRLQFSQAGASDIRDQSRNWLPGPCYRQQRVSKTDGENNNSDFSWTGATKYHLNGRDSLVNPGPAMASHKDDEEKFFPQSGVLIFGKEGAGAADADVDHVMITDEEEIRTTNPVATEQYGSVSTNLQAGNAQAATADVN

SEQ ID NO: 6065 - protein, 334 aa, Artificial Sequence; identical to SEQ ID NO: 1059
  Synthetic

SEQ ID NO: 6066 - protein, 334 aa, Artificial Sequence; identical to SEQ ID NO: 3378
  Synthetic

SEQ ID NO: 6067 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGDTGHTTISRLGFSQAGASDIRDQSRNWLPGPCYRQQRVSKQPTGNNNSEFSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6068 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDRFFPQSGVLIFGKEDGGKSNVEIDRVMITDEEEIRTTNPVATEQYGSVSTNLQAGNAQAATADVN

SEQ ID NO: 6069 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6070 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSSDNNNSEFSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 6071 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDTRTGAAAGKVD

SEQ ID NO: 6072 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTYNHNNNSEFSWTGATKYHLNGRDSLVNPGPAMASHKDDDDKFFPQSGVLIFGKQDSGGTNVDIGHVMITDEEEIRTTNPVATEQYGSVSTNLQAGNAQAATADVN

SEQ ID NO: 6073 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNAGPKTNSALSFSQAGASDIRDQSRNWLPGPCYRQQRVSKTPNDNNNSNFSWTGATKYHLNGRDSLVNPGPAMASHKDDEEKFFPQSGVLIFGKQDGGGADVAIDKVMITDEEEIRTTNPVATEQYGSVSTNLQAGNAQAATADVN

SEQ ID NO: 6074 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQPTRNNNSEFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 6075 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGGKATNVDFDGVMITDEEEIRTTNPVATEQYGSVSTNLQAGNAQAATADVN

SEQ ID NO: 6076 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6077 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSTQSTGNNNSDFSWTGATKYHLNGRDSLVNPGPAMASHKDDDDRFFPQSGVLIFGKEGTEKTNVDIEKVMITDEEEIRTTNPVATEQYGSVSTNLQAGNAQAATADVN

SEQ ID NO: 6078 - protein, 334 aa, Artificial Sequence; identical to SEQ ID NO: 652
  Synthetic

SEQ ID NO: 6079 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSKTPSHNNNSDFSWSGATKYHLNGRDSLVNPGPAMASHRDDEEKFFPQSGVLIFGKEGAGKTNIAVDRVMITDEEEIRTTNPVATEQYGSVSTNLQAGNAQAATADVN

SEQ ID NO: 6080 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGNQTISKLNFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6081 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDRNNNSDFSWTGATKYHLNGRDSLVNPGPAMASHKDDDDRFFPQSGVLIFGKEGGTGANIEIGDVMITDEEEIRTTNPVATEQYGSVSTNLQAGNAQAATADVN

SEQ ID NO: 6082 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHAGSHTMSSLRFSQAGASDIRDQSRNWLPGPCYRQQRVSKTDGENNNSDFSWTGATKYHLNGRDSLVNPGPAMASHKDDEEKFFPQSGVLIFGKQSGGRSNVEIDQVMITDEEEIRTTNPVATEQYGSVSTNLQAGNAQAATADVN

SEQ ID NO: 6083 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAQSGTATLSRLQFSQAGASDIRDQSRNWLPGPCYRQQRVSKTSADNNNSEYSWPGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6084 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQGTGASNADIDHVMITDEEEIRTTNPVATEQYGSVSTNLQAGNAQAATADVN

SEQ ID NO: 6085 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAGTNDIDIERVMITDEEEIRTTNPVATEQYGSVSTNLQAGNAQAATADVN

SEQ ID NO: 6086 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 6087 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAAGADTAIDDVMITDEEEIRTTNPVATEQYGSVSTNLQAGNAQAATADVN

SEQ ID NO: 6088 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNTTQSRLHFSQAGASDIRDQSRNWLPGPCYRQQRVSTTPADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6089 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKTSADNNNSEYSWTGATKYHLNGRDSLVNPGPAMASHKDDADRFFPQSGVLIFGKQGASKTNIDIGKVMITDEEEIRTTNPVATEQYGSVSTNLQAGNAQAATADVN

SEQ ID NO: 6090 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQSARGANADYDDVMITDEEEIRTTNPVATEQYGSVSTNLQAGNAQAATADVN

SEQ ID NO: 6091 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNATHSQLRFSQAGASDIRDQSRNWLPGPCYRQQRVSKTSADNNNSEYSWTGATKYHLNGRDSLVNPGPAMASHKDDEEKFFPQSGVLIFGKEGAGKTNIAVDRVMITDEEEIRTTNPVATEQYGSVSTNLQAGNAQAATADVN

SEQ ID NO: 6092 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNLTTSELRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6093 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKESGTTSNVDIGGVMITDEEEIRTTNPVATEQYGSVSTNLQAGNAQAATADVN

SEQ ID NO: 6094 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQGADKANVDIGKVMITDEEEIRTTNPVATEQYGSVSTNLQAGNAQAATADVN

SEQ ID NO: 6095 - protein, 334 aa, Artificial Sequence; identical to SEQ ID NO: 791
  Synthetic

SEQ ID NO: 6096 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGIQTMSNLRFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 6097 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6098 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGARKSNVEVGEVMITDEEEIRTTNPVATEQYGSVSTNLQAGNAQAATADVN

SEQ ID NO: 6099 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGNDTKSPLKFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQRGNRQAATADVN

SEQ ID NO: 6100 - protein, 334 aa, Artificial Sequence; identical to SEQ ID NO: 375
  Synthetic

SEQ ID NO: 6101 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNNHGPAATADVQ

SEQ ID NO: 6102 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6103 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRHTRAAAEAVE

SEQ ID NO: 6104 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDNDKFFPQSGVLIFGKENAAGGDTDIGRVMITDEEEIRTTNPVATEQYGSVSTNLQRGNRQAATADVN

SEQ ID NO: 6105 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDERFFPQSGVLIFGKESATGDNVEIGQVMITDEEEIRTTNPVATEQYGSVSTNLQAGNAQAATADVN

SEQ ID NO: 6106 - protein, 334 aa, Artificial Sequence; identical to SEQ ID NO: 64
  Synthetic

SEQ ID NO: 6107 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAENNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6108 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNAQAATADVN

SEQ ID NO: 6109 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKTYNDNNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6110 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAHSGGAAFETVA

SEQ ID NO: 6111 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTAGTQTHSQLLFSQAGASDIRDQSRNWLPGPCYRQQRVSKTSADNNNSNFSWTGATKYHLNGRDSLVNPGPAMASHEDDNGRFFPQSGVLIFGKQGSEKTNVDIEKVMITDEEEIRTTNPVATEQYGSVSTNLQAGNAQAATADVN

SEQ ID NO: 6112 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNHAAAAFDMVN

SEQ ID NO: 6113 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDAGRFFPQSGVLIFGKEDAGTTNVAFDKVMITDEEEIRTTNPVATEQYGSVSTNLQAGNAQAATADVN

SEQ ID NO: 6114 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6115 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6116 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTYAGNNNSNFSWTGATKYHLNGRDSLVNPGPAMASHKDDEGRFFPQSGVLIFGKEGTEKSNVAIERVMITDEEEIRTTNPVATEQYGSVSTNLQAGNAQAATADVN

SEQ ID NO: 6117 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGQAPAAATEVQ

SEQ ID NO: 6118 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKENSGKANVDIEQVMITDEEEIRTTNPVATEQYGSVSTNLQAGNAQAATADVN

SEQ ID NO: 6119 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTADHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6120 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGPMTISNLRFSQAGASDIRDQSRNWLPGPCYRQQRVSKTSADNNNSEYSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 6121 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGNQTISKLNFSQAGASDIRDQSRNWLPGPCYRQQRVSKTAADNNNSDFSWTGATKYHLNGRDSLVNPGPAMASHKDDEDKFFPQSGVLIFGKEGTGANNAEIGEVMITDEEEIRTTNPVATEQYGSVSTNLQAGNAQAATADVN

SEQ ID NO: 6122 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQATRAQAAVDNVN

SEQ ID NO: 6123 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHKDDDDRFFPQSGVLIFGKQDSAASNVEFGQVMITDEEEIRTTNPVATEQYGSVSTNLQAGNAQAATADVN

SEQ ID NO: 6124 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6125 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRDPAANNGVN

SEQ ID NO: 6126 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDAEKFFPQSGVLIFGKEGAGTNDIDIEKVMITDEEEIRTTNPVATEQYGSVSTNLQAGNAQAATADVN

SEQ ID NO: 6127 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKTYNDNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6128 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSEAGIHTQSQLLFSQAGASDIRDQSRNWLPGPCYRQQRVSKQSDRNNNSEFSWTGATKYHLNGRDSLVNPGPAMASHKDDEDKFFPQSGVLIFGKQNAGATDVDIGSVMITDEEEIRTTNPVATEQYGSVSTNLQAGNAQAATADVN

SEQ ID NO: 6129 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNETKSGLVFSQAGASDIRDQSRNWLPGPCYRQQRVSKQPNDNNNSEFSWPGATKYHLNGRDSLVNPGPAMASHKDDEEKFFPQSGVLIFGKQGAGKNNVEVESVMITDEEEIRTTNPVATEQYGSVSTNLQAGNAQAATADVN

SEQ ID NO: 6130 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGSTTTSKLKFSQAGASDIRDQSRNWLPGPCYRQQRVSKTAADNNNSDFSWTGATKYHLNGRDSLVNPGPAMASHKDDDGKFFPQSGVLIFGKQGAGETNVDVGKVMITDEEEIRTTNPVATEQYGSVSTNLQAGNAQAATADVN

SEQ ID NO: 6131 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHKDDEGRFFPQSGVLIFGKEGAGRDDVDVEEVMITDEEEIRTTNPVATEQYGSVSTNLQAGNAQAATADVN

SEQ ID NO: 6132 - protein, 334 aa, Artificial Sequence; identical to SEQ ID NO: 4133
  Synthetic

SEQ ID NO: 6133 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6134 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKSGTMTKSPLMFSQAGASDIRDQSRNWLPGPCYRQQRVSKTSADNNNSNFSWTGATKYHLNGRDSLVNPGPAMASHKDDDEKFFPQSGVLIFGKEDSAKGNTDIDNVMITDEEEIRTTNPVATEQYGSVSTNLQAGNAQAATADVN

SEQ ID NO: 6135 - protein, 334 aa, Artificial Sequence; identical to SEQ ID NO: 2512
  Synthetic

SEQ ID NO: 6136 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGNPTMSELRFSQAGASDIRDQSRNWLPGPCYRQQRVSKTSTENNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6137 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSTKSGAAYSAVQ

SEQ ID NO: 6138 - protein, 334 aa, Artificial Sequence; identical to SEQ ID NO: 573
  Synthetic

SEQ ID NO: 6139 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDEEKFFPQSGVLIFGKQGADGANVAYDRVMITDEEEIRTTNPVATEQYGSVSTNLQAGNAQAATADVN

SEQ ID NO: 6140 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESAGRSNVDVDRVMITDEEEIRTTNPVATEQYGSVSTNLQAGNAQAATADVN

SEQ ID NO: 6141 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGLATKSNLGFSQAGASDIRDQSRNWLPGPCYRQQRVSKTSADNNNSEYSWTGATKYHLNGRDSLVNPGPAMASHKDDEEKFFPQSGVLIFGKQGAGTTDVEYGQVMITDEEEIRTTNPVATEQYGSVSTNLQAGNAQAATADVN

SEQ ID NO: 6142 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDSETDNVDIGDVMITDEEEIRTTNPVATEQYGSVSTNLQAGNAQAATADVN

SEQ ID NO: 6143 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQNATGTNVDVGSVMITDEEEIRTTNPVATEQYGSVSTNLQAGNAQAATADVN

SEQ ID NO: 6144 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTDGENNNSDFSWTGATKYHLNGRDSLVNPGPAMASHKDDEEKFFPQSGVLIFGKEGTGGSNIDYDRVMITDEEEIRTTNPVATEQYGSVSTNLQAGNAQAATADVN

SEQ ID NO: 6145 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPSENNNSDFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6146 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQADRNNNSNFSWTGATTYHLNGRDSLVNPGPAMASHKDDEDKFFPQSGVLIFGKEDAKKNNVDYENVMITDEEEIRTTNPVATEQYGSVSTNLQAGNAQAATADVN

SEQ ID NO: 6147 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDTDRFFPQSGVLIFGKQDGGRTNVDVDGVMITDEEEIRTTNPVATEQYGSVSTNLQRGNRQAATADVN

SEQ ID NO: 6148 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKQDTDNNNSDFSWTGATKYHLNGRDSLVNPGPAMASHKDDDDRFFPQSGVLIFGKQGSGKSNVEIDRVMITDEEEIRTTNPVATEQYGSVSTNLQAGNAQAATADVN

SEQ ID NO: 6149 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGIATLSRLRFSQAGASDIRDQSRNWLPGPCYRQQRVSKTSADNNNSEYSWTGATKYHLNGRDSLVNPGPAMASHRDDNEKFFPQSGVLIFGKEGAEGSNVDIGGVMITDEEEIRTTNPVATEQYGSVSTNLQAGNAQAATADVN

SEQ ID NO: 6150 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTSADNNNSEYSWTGATKYHLNGRDSLVNPGPAMASHKDDDEKFFPQSGVLIFGKEGAGANDVAVEHVMITDEEEIRTTNPVATEQYGSVSTNLQAGNAQAATADVN

SEQ ID NO: 6151 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGNQTISKLNFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6152 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 6153 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6154 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQSAAAANIDFEHVMITDEEEIRTTNPVATEQYGSVSTNLQAGNAQAATADVN

SEQ ID NO: 6155 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQAGNRQAATADVN

SEQ ID NO: 6156 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6157 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRGGTLTPSGLGFSQAGASDIRDQSRNWLPGPCYRQQRVSKQPSENNNSDFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6158 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6159 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEAGNVAVEDVMITDEEEIRTTNPVATEQYGSVSTNLQAGNAQAATADVN

SEQ ID NO: 6160 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTPSALKFSQAGASDIRDQSRNWLPGPCYRQQRVSKTHGDNNNSNFSWTGATKYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 6161 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSAKDSAADNGVN

SEQ ID NO: 6162 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKAGIKTKSSLGFSQAGASDIRDQSRNWLPGPCYRQQRVSKTSADNNNSEYSWTGATKYHLNGRDSLVNPGPAMASHKDDDERFFPQSGVLIFGKQGTGKNNIAFEDVMITDEEEIRTTNPVATEQYGSVSTNLQAGNAQAATADVN

SEQ ID NO: 6163 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEGSEKTNVDIEKVMITDEEEIRTTNPVATEQYGSVSTNLQAGNAQAATADVN

SEQ ID NO: 6164 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6165 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGNQTQSALRFSQAGASDIRDQSRNWLPGPCYRQQRVSKKYTDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6166 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKEGSRRDNAAIEHVMITDEEEIRTTNPVATEQYGSVSTNLQAGNAQAATADVN

SEQ ID NO: 6167 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQARSNRAAFDVVH

SEQ ID NO: 6168 - protein, 334 aa, Artificial Sequence; identical to SEQ ID NO: 2640
  Synthetic

SEQ ID NO: 6169 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGHPTLSTLLFSQAGASDIRDQSRNWLPGPCYRQQRVSTQADRNDNSNFSWTGATTYHLNGRDSLVNPGPAMASHGDDTDKFFPQSGVLIFGKQSAKAANAAIDEVMITDEEEIRTTNPVATEQYGSVSTNLQAGNAQAATADVN

SEQ ID NO: 6170 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNPRGAAASAGVE

SEQ ID NO: 6171 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRTHAATSDVH

SEQ ID NO: 6172 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDDEKFFPQSGVLIFGKEGTAKSNVEYEKVMITDEEEIRTTNPVATEQYGSVSTNLQAGNAQAATADVN

SEQ ID NO: 6173 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSTQDGENNNSDFSWTGATKYHLNGRDSLVNPGPAMASHKDDEDKFFPQSGVLIFGKEDSGAGNVAVEGVMITDEEEIRTTNPVATEQYGSVSTNLQAGNAQAATADVN

SEQ ID NO: 6174 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTHGDNNNSNFSWTGATTYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6175 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6176 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEGGLQTMSALKFSQAGASDIRDQSRNWLPGPCYRQQRVSKKDSRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6177 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDGGGSNVDIEGVMITDEEEIRTTNPVATEQYGSVSTNLQAGNAQAATADVN

SEQ ID NO: 6178 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAKGGNMTLSRLKFSQAGASDIRDQSRNWLPGPCYRQQRVSKTYNDNNNSEFSWTGATTYHLNGRDSLVNPGPAMASHKDDDERFFPQSGVLIFGKESSGKTDVDVGGVMITDEEEIRTTNPVATEQYGSVSTNLQAGNAQAATADVN

SEQ ID NO: 6179 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDNEKFFPQSGVLIFGKQGSEKTNVDIEKVMITDEEEIRTTNPVATEQYGSVSTNLQAGNAQAATADVN

SEQ ID NO: 6180 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTDGENNNSDFSWTGATKYHLNGRDSLVNPGPAMASHKDDEEKFFPQSGVLIFGKEDANRNNVEIERVMITDEEEIRTTNPVATEQYGSVSTNLQAGNAQAATADVN

SEQ ID NO: 6181 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDAAKTNAAVDQVMITDEEEIRTTNPVATEQYGSVSTNLQAGNAQAATADVN

SEQ ID NO: 6182 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSNFSWTGATTYHLNGRDSLVNPGPAMASHKDDEGRFFPQSGVLIFGKQNGGTGNVAIDRVMITDEEEIRTTNPVATEQYGSVSTNLQAGNAQAATADVN

SEQ ID NO: 6183 - protein, 334 aa, Artificial Sequence
  Synthetic
NTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6184 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGNETMSRLSFSQAGASDIRDQSRNWLPGPCYRQQRVSKTDGENNNSDFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 6185 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSGLRFSQAGASDIRDQSRNWLPGPCYRQQRVSKTDGENNNSDFSWTGATKYHLNGRDSLVNPGPAMASHKDDDGKFFPQSGVLIFGKQGATGTNIDFERVMITDEEEIRTTNPVATEQYGSVSTNLQAGNAQAATADVN

SEQ ID NO: 6186 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSKTSADNNNSNFSWTGATTYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 6187 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGHNTLSGLRFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6188 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDDEKFFPQSGVLIFGKQSAKAANAAIDEVMITDEEEIRTTNPVATEQYGSVSTNLQRGNRQAATADVN

SEQ ID NO: 6189 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHRDDNDKFFPQSGVLIFGKQGAGKTNTDVENVMITDEEEIRTTNPVATEQYGSVSTNLQAGNAQAATADVN

SEQ ID NO: 6190 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSADNNNSDFSWTGATKYHLNGRDSLVNPGPAMASHKDDDDRFFPQSGVLIFGKESSSEDNVDIGGVMITDEEEIRTTNPVATEQYGSVSTNLQAGNAQAATADVN

SEQ ID NO: 6191 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSTKAADNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6192 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGTTGADVEVGGVMITDEEEIRTTNPVATEQYGSVSTNLQAGNAQAATADVN

SEQ ID NO: 6193 - protein, 334 aa, Artificial Sequence; identical to SEQ ID NO: 405
  Synthetic

SEQ ID NO: 6194 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQSAEKTNAEVDDVMITDEEEIRTTNPVATEQYGSVSTNLQAGNAQAATADVN

SEQ ID NO: 6195 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGTITKSNLMFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQRGNRQAATADVN

SEQ ID NO: 6196 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAENNNSEFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6197 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDDRFFPQSGVLIFGKEGAAADNIDIGQVMITDEEEIRTTNPVATEQYGSVSTNLQAGNAQAATADVN

SEQ ID NO: 6198 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQTGSPTTSDLKFSQAGASDIRDQSRNWLPGPCYRQQRVSKVSADNNNSEFSWTGATKYHLNGRDSLVNPGPAMASHEDDAGRFFPQSGVLIFGKEGSGGTDIAYEEVMITDEEEIRTTNPVATEQYGSVSTNLQAGNAQAATADVN

SEQ ID NO: 6199 - protein, 334 aa, Artificial Sequence; identical to SEQ ID NO: 163
  Synthetic

SEQ ID NO: 6200 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKQGASAADVEIEDVMITDEEEIRTTNPVATEQYGSVSTNLQAGNAQAATADVN

SEQ ID NO: 6201 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATSGNDTKSPLKFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 6202 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6203 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKEGAGGTDIDIGHVMITDEEEIRTTNPVATEQYGSVSTNLQAGNAQAATADVN

SEQ ID NO: 6204 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6205 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNARSGAASRDVH

SEQ ID NO: 6206 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKQGARAANIDIGQVMITDEEEIRTTNPVATEQYGSVSTNLQRGNRQAATADVN

SEQ ID NO: 6207 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAESSGAAAEIVE

SEQ ID NO: 6208 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6209 - protein, 334 aa, Artificial Sequence
  Synthetic
HAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGASTDDADVGEVMITDEEEIRTTNPVATEQYGSVSTNLQAGNAQAATADVN

SEQ ID NO: 6210 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSEFSWTGATKYHLNGRDSLVNPGPAMASHKDDEEKFFPQSGVLIFGKEGTAAANADIDGVMITDEEEIRTTNPVATEQYGSVSTNLQAGNAQAATADVN

SEQ ID NO: 6211 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 6212 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQTGAAYTNVP

SEQ ID NO: 6213 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKQPSENNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 6214 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQDAENNNSEFSWPGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 6215 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQNSGATDVAIGGVMITDEEEIRTTNPVATEQYGSVSTNLQAGNAQAATADVN

SEQ ID NO: 6216 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEGAGKTNIAVDRVMITDEEEIRTTNPVATEQYGSVSTNLQAGNAQAATADVN

SEQ ID NO: 6217 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDNHNNNSNFSWTGATKYHLNGRDSLVNPGPAMASHKDDDEKFFPQSGVLIFGKQNGGTGNVAIDRVMITDEEEIRTTNPVATEQYGSVSTNLQAGNAQAATADVN

SEQ ID NO: 6218 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGHPTLSQLKFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6219 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDDGNNNSNFSWTGATTYHLNGRDSLVNPGPAMASHKDDDDRFFPQSGVLIFGKQSGATGNAAIGEVMITDEEEIRTTNPVATEQYGSVSTNLQAGNAQAATADVN

SEQ ID NO: 6220 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQYDRNNNSNFSWTGATKYHLNGRDSLVNPGPAMASHRDDEDKFFPQSGVLIFGKQSAKAANAAIDEVMITDEEEIRTTNPVATEQYGSVSTNLQAGNAQAATADVN

SEQ ID NO: 6221 - protein, 334 aa, Artificial Sequence; identical to SEQ ID NO: 1925
  Synthetic

SEQ ID NO: 6222 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTDGENNNSDFSWTGATKYHLNGRDSLVNPGPAMASHKDDGEKFFPQSGVLIFGKQGSEKTNVDIEKVMITDEEEIRTTNPVATEQYGSVSTNLQRGNRQAATADVN

SEQ ID NO: 6223 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTSADNNNSEYSWTGATKYHLNGRDSLVNPGPAMASHGDDNDKFFPQSGVLIFGKEGAGKTNIAVDRVMITDEEEIRTTNPVATEQYGSVSTNLQAGNAQAATADVN

SEQ ID NO: 6224 - protein, 334 aa, Artificial Sequence; identical to SEQ ID NO: 2841
  Synthetic

SEQ ID NO: 6225 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPGGSETNSRLRFSQAGASDIRDQSRNWLPGPCYRQQRVSKPPNGNNNSEFSWTGATKYHLNGRDSLVNPGPAMASHKDDEEKFFPQSGVLIFGKENAATANAAIEEVMITDEEEIRTTNPVATEQYGSVSTNLQAGNAQAATADVN

SEQ ID NO: 6226 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRAGSKTNSALHFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6227 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHKDDADRFFPQSGVLIFGKEGANGGNADIEDVMITDEEEIRTTNPVATEQYGSVSTNLQAGNAQAATADVN

SEQ ID NO: 6228 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6229 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6230 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGASGSDIEIDRVMITDEEEIRTTNPVATEQYGSVSTNLQAGNAQAATADVN

SEQ ID NO: 6231 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKQPTRNNNSDFSWTGATKYHLNGRDSLVNPGPAMASHEDDNGKFFPQSGVLIFGKQGSEKTNVDIEKVMITDEEEIRTTNPVATEQYGSVSTNLQAGNAQAATADVN

SEQ ID NO: 6232 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQNTPAAIRTVA

SEQ ID NO: 6233 - protein, 334 aa, Artificial Sequence; identical to SEQ ID NO: 1005
  Synthetic

SEQ ID NO: 6234 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSEFSWTGATKYHLNGRDSLVNPGPAMASHKDDEDKFFPQSGVLIFGKQGAKGTNVAVEKVMITDEEEIRTTNPVATEQYGSVSTNLQAGNAQAATADVN

SEQ ID NO: 6235 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDNEKFFPQSGVLIFGKQGASTTNAAIEDVMITDEEEIRTTNPVATEQYGSVSTNLQAGNAQAATADVN

SEQ ID NO: 6236 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGHKTTSRLGFSQAGASDIRDQSRNWLPGPCYRQQRVSKKSTDNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6237 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRSTAASAEVP

SEQ ID NO: 6238 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQGSEKTNVDIEKVMITDEEEIRTTNPVATEQYGSVSTNLQAGNAQAATADVN

SEQ ID NO: 6239 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEEKFFPQSGVLIFGKQGTNESDVDIEKVMITDEEEIRTTNPVATEQYGSVSTNLQAGNAQAATADVN

SEQ ID NO: 6240 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGSATQSHLRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6241 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 6242 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6243 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHRDDEDKFFPQSGVLIFGKEDAGTTNVAFDKVMITDEEEIRTTNPVATEQYGSVSTNLQAGNAQAATADVN

SEQ ID NO: 6244 - protein, 334 aa, Artificial Sequence; identical to SEQ ID NO: 1977
  Synthetic

SEQ ID NO: 6245 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGTNESDVDIEKVMITDEEEIRTTNPVATEQYGSVSTNLQRGNRQAATADVN

SEQ ID NO: 6246 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEDGGGSNVEIGRVMITDEEEIRTTNPVATEQYGSVSTNLQAGNAQAATADVN

SEQ ID NO: 6247 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6248 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKKDAENNNSEFSWPGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6249 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKQDGTGGDVAIERVMITDEEEIRTTNPVATEQYGSVSTNLQAGNAQAATADVN

SEQ ID NO: 6250 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHGDDNDRFFPQSGVLIFGKQDSSAGNVDYEGVMITDEEEIRTTNPVATEQYGSVSTNLQAGNAQAATADVN

SEQ ID NO: 6251 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGRAGAADTEVQ

SEQ ID NO: 6252 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASTGINTLSTLQFSQAGASDIRDQSRNWLPGPCYRQQRVSKTEGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6253 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQGPNNAAAYREVQ

SEQ ID NO: 6254 - protein, 334 aa, Artificial Sequence; identical to SEQ ID NO: 562
  Synthetic

SEQ ID NO: 6255 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAGNNNSKFSWTGATKYHLNGRDSLVNPGPAMASHKDDDERFFPQSGVLIFGKENGTKGNIDIEKVMITDEEEIRTTNPVATEQYGSVSTNLQAGNAQAATADVN

SEQ ID NO: 6256 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSKSGPATKSALGFSQAGASDIRDQSRNWLPGPCYRQQRVSKTSADNNNSEYSWTGATKYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6257 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKQPAGNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6258 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGGGNVTQSKLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6259 - protein, 334 aa, Artificial Sequence
  Synthetic
DAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKEGSGKANVEIGRVMITDEEEIRTTNPVATEQYGSVSTNLQAGNAQAATADVN

SEQ ID NO: 6260 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGNTTMSRLGFSQAGASDIRDQSRNWLPGPCYRQQRVSKTPDGNNNSDFSWTGATKYHLNGRDSLVNPGPAMASHKDDDDRFFPQSGVLIFGKQGSEKTNVDIEKVMITDEEEIRTTNPVATEQYGSVSTNLQGQKDRAASTDVH

SEQ ID NO: 6261 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQATKAPAASDGVT

SEQ ID NO: 6262 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAKGNNVEVGQVMITDEEEIRTTNPVATEQYGSVSTNLQAANAQAATADVD

SEQ ID NO: 6263 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKDKFFPQSGVLIFGKQGASKTNIDIGKVMITDEEEIRTTNPVATEQYGSVSTNLQAGNAQAATADVN

SEQ ID NO: 6264 - protein, 334 aa, Artificial Sequence
  Synthetic
QTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKRGSEKTNVDIEKVMITDEEEIRTTNPVATEQYGSVSTNLQSERAGAAYQDVQ

SEQ ID NO: 6265 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQAHAASDMVE

SEQ ID NO: 6266 - protein, 334 aa, Artificial Sequence; identical to SEQ ID NO: 4025
  Synthetic

SEQ ID NO: 6267 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDADKFFPQSGVLIFGKENGEANNAEIDEVMITDEEEIRTTNPVATEQYGSVSTNLQAGNAQAATADVN

SEQ ID NO: 6268 - protein, 334 aa, Artificial Sequence; identical to SEQ ID NO: 1190
  Synthetic

SEQ ID NO: 6269 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGASTDDADVGEVMITDEEEIRTTNPVATEQYGSVSTNLQAGNAQAATADVN

SEQ ID NO: 6270 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSNTSADNNNSEYSWTGATKYHLNGRDSLVNPGPAMASHRDDAEKFFPQSGVLIFGKEDSNGNNIAIDKVMITDEEEIRTTNPVATEQYGSVSTNLQAGNAQAATADVN

SEQ ID NO: 6271 - protein, 334 aa, Artificial Sequence
  Synthetic
RTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6272 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKTSADNNNSEYSWTGATTYHLNGRDSLVNPGPAMASHGDDDERFFPQSGVLIFGKQGSEKTNVDIEKVMITDEEEIRTTNPVATEQYGSVSTNLQAGNAQAATADVN

SEQ ID NO: 6273 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6274 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQAGNRQAATADVN

SEQ ID NO: 6275 - protein, 334 aa, Artificial Sequence; identical to SEQ ID NO: 3006
  Synthetic

SEQ ID NO: 6276 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSQTKSELQFSQAGASDIRDQSRNWLPGPCYRQQRVSKTDGENNNSDFSWTGATKYHLNGRDSLVNPGPAMASHKDDEEKFFPQSGVLIFGKEDTGADNVDIDSVMITDEEEIRTTNPVATEQYGSVSTNLQAGNAQAATADVN

SEQ ID NO: 6277 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDEEKFFPQSGVLIFGKQGGGTDNVDIDRVMITDEEEIRTTNPVATEQYGSVSTNLQAGNAQAATADVN

SEQ ID NO: 6278 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDDDKFFPQSGVLIFGKQGTGASNVEVENVMITDEEEIRTTNPVATEQYGSVSTNLQAGNAQAATADVN

SEQ ID NO: 6279 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKQGARAANIDIGQVMITDEEEIRTTNPVATEQYGSVSTNLQAGNAQAATADVN

SEQ ID NO: 6280 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSTQPTENNNSDFSWTGATKYHLNGRDSLVNPGPAMASHKDDEDKFFPQSGVLIFGKQGAAETDVDIENVMITDEEEIRTTNPVATEQYGSVSTNLQAGNAQAATADVN

SEQ ID NO: 6281 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGRKTLSNLEFSQAGASDIRDQSRNWLPGPCYRQQRVSKTSGGNNNSEFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6282 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGARANNIEVDQVMITDEEEIRTTNPVATEQYGSVSTNLQAGNAQAATADVN

SEQ ID NO: 6283 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTTTPSKLIFSQAGASDIRDQSRNWLPGPCYRQQRVSTKSNENNNSDFSWTGATTYHLNGRDSLVNPGPAMASHKDDEEKFFPQSGVLIFGKQGAGANNVAIGDVMITDEEEIRTTNPVATEQYGSVSTNLQAGNAQAATADVN

SEQ ID NO: 6284 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGINTLSTLQFSQAGASDIRDQSRNWLPGPCYRQQRVSKQDAENNNSEFSWPGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 6285 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGDRQAATADVN

SEQ ID NO: 6286 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDSAKANVDIGQVMITDEEEIRTTNPVATEQYGSVSTNLQAGNAQAATADVN

SEQ ID NO: 6287 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6288 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTETGSPTISGLQFSQAGASDIRDQSRNWLPGPCYRQQRVSKQASDNNNSNFSWTGATTYHLNGRDSLVNPGPAMASHKDDEGRFFPQSGVLIFGKEGGATGNVDVDKVMITDEEEIRTTNPVATEQYGSVSTNLQAGNAQAATADVN

SEQ ID NO: 6289 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDSGRADVAFESVMITDEEEIRTTNPVATEQYGSVSTNLQAGNAQAATADVN

SEQ ID NO: 6290 - protein, 334 aa, Artificial Sequence; identical to SEQ ID NO: 3070
  Synthetic

SEQ ID NO: 6291 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPGGNNNSNFSWTGATKYHLNGRDSLVNPGPAMASHKDDDDKFFPQSGVLIFGKQGGAGSNVAVEEVMITDEEEIRTTNPVATEQYGSVSTNLQAGNAQAATADVN

SEQ ID NO: 6292 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDERFFPQSGVLIFGKEDGARANVAIGEVMITDEEEIRTTNPVATEQYGSVSTNLQAGNAQAATADVN

SEQ ID NO: 6293 - protein, 334 aa, Artificial Sequence; identical to SEQ ID NO: 1197
  Synthetic

SEQ ID NO: 6294 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTTGSKTMSKLRFSQAGASDIRDQSRNWLPGPCYRQQRVSKQDAENNNSEFSWPGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6295 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKENAAANNADYESVMITDEEEIRTTNPVATEQYGSVSTNLQAGNAQAATADVN

SEQ ID NO: 6296 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHKDDDEKFFPQSGVLIFGKESGTKGNAEVDDVMITDEEEIRTTNPVATEQYGSVSTNLQAGNAQAATADVN

SEQ ID NO: 6297 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPDHNNNSDFSWTGATKYHLNGRDSLVNPGPAMASHKDDNGRFFPQSGVLIFGKEDSTKDNVAIDRVMITDEEEIRTTNPVATEQYGSVSTNLQAGNAQAATADVN

SEQ ID NO: 6298 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSADNNNSEYSWTGATKYHLNGRDSLVNPGPAMASHGDDNDKFFPQSGVLIFGKQGSEKTNVDIEKVMITDEEEIRTTNPVATEQYGSVSTNLQRGNRQAATADVN

SEQ ID NO: 6299 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDKFFPQSGVLIFGKQDSERTDVEIEKVMITDEEEIRTTNPVATEQYGSVSTNLQAGNAQAATADVN

SEQ ID NO: 6300 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGESGLQTNSTLRFSQAGASDIRDQSRNWLPGPCYRQQRVSKTPTGNNNSDFSWTGATKYHLNGRDSLVNPGPAMASHKDDDDRFFPQSGVLIFGKESGTANDVDIDRVMITDEEEIRTTNPVATEQYGSVSTNLQAGNAQAATADVN

SEQ ID NO: 6301 - protein, 334 aa, Artificial Sequence; identical to SEQ ID NO: 630
  Synthetic

SEQ ID NO: 6302 - protein, 334 aa, Artificial Sequence; identical to SEQ ID NO: 897
  Synthetic

SEQ ID NO: 6303 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGESNADYEQVMITDEEEIRTTNPVATEQYGSVSTNLQAGNAQAATADVN

SEQ ID NO: 6304 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDDDRFFPQSGVLIFGKENSDGNDTDIDGVMITDEEEIRTTNPVATEQYGSVSTNLQAGNAQAATADVN

SEQ ID NO: 6305 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKEDGDGANVAIDRVMITDEEEIRTTNPVATEQYGSVSTNLQAGNAQAATADVN

SEQ ID NO: 6306 - protein, 334 aa, Artificial Sequence; identical to SEQ ID NO: 1210
  Synthetic

SEQ ID NO: 6307 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGTGASNADIDHVMITDEEEIRTTNPVATEQYGSVSTNLQAGNAQAATADVN

SEQ ID NO: 6308 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTYNDNNNSEFSWTGATTYHLNGRDSLVNPGPAMASHKDDDERFFPQSGVLIFGKQNGRKGNVAIEEVMITDEEEIRTTNPVATEQYGSVSTNLQAGNAQAATADVN

SEQ ID NO: 6309 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKASDNNNSNFSWTGATTYHLNGRDSLVNPGPAMASHKDDEGRFFPQSGVLIFGKQGSEKTNVDIEKVMITDEEEIRTTNPVATEQYGSVSTNLQRGNRQAATADVN

SEQ ID NO: 6310 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAGESNADYEQVMITDEEEIRTTNPVATEQYGSVSTNLQAGNAQAATADVN

SEQ ID NO: 6311 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDDDRFFPQSGVLIFGKQGSTGTNTDIGQVMITDEEEIRTTNPVATEQYGSVSTNLQAGNAQAATADVT

SEQ ID NO: 6312 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKPSHNNNSEFSWTGATKYHLNGRDSLVNPGPAMASHKDDEEKFFPQSGVLIFGKQGSEKTNVDIEKVMITDEEEIRTTNPVATEQYGSVSTNLQTGSTRAADEKVN

SEQ ID NO: 6313 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDAAGNNVAIEEVMITDEEEIRTTNPVATEQYGSVSTNLQAGNAQAATADVN

SEQ ID NO: 6314 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPGGNQTTSGLRFSQAGASDIRDQSRNWLPGPCYRQQRVSKTSADNNNSEYSWTGATKYHLNGRDSLVNPGPAMASHKDDEEKFFPQSGVLIFGKQSSGTGDIAVDQVMITDEEEIRTTNPVATEQYGSVSTNLQAGNAQAATADVN

SEQ ID NO: 6315 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDAEKFFPQSGVLIFGKEGAGTNDIDIEKVMITDEEEIRTTNPVATEQYGSVSTNLQAGNAQAATADVN

SEQ ID NO: 6316 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAHAGSHTMSSLRFSQAGASDIRDQSRNWLPGPCYRQQRVSKTDGENNNSDFSWTGATKYHLNGRDSLVNPGPAMASHKDDEEKFFPQSGVLIFGKQSGGRSNVEIDQVMITDEEEIRTTNPVATEQYGSVSTNLQAGNAQAATADVN

SEQ ID NO: 6317 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGAAKYHLNGRDSLVNPGPAMASHKDDDEKFFPQSGVLIFGKEGAGANDVAVEHVMITDEEEIRTTNPVATEQYGSVSTNLQAGNAQAATADVN

SEQ ID NO: 6318 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHGDDTGKFFPQSGVLIFGKQGSEKTNVDIEKVMITDEEEIRTTNPVATEQYGSVSTNLQAGNAQAATADVN

SEQ ID NO: 6319 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6320 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGHMTPSRLQFSQAGASDIRDQSRNWLPGPCYRQQRVSKQPNDNNNSEFSWTGATTYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6321 - protein, 334 aa, Artificial Sequence; identical to SEQ ID NO: 159
  Synthetic

SEQ ID NO: 6322 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDGKFFPQSGVLIFGKEGTTKANVDVGDVMITDEEEIRTTNPVATEQYGSVSTNLQAGNAQAATADVN

SEQ ID NO: 6323 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGRVTISGLRFSQAGASDIRDQSRNWLPGPCYRQQRVSKVSADNNNSEFSWTGATKYHLNGRDSLVNPGPAMASHRDDEEKFFPQSGVLIFGKESGGKGNVEIEQVMITDEEEIRTTNPVATEQYGSVSTNLQAGNAQAATADVN

SEQ ID NO: 6324 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6325 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSNRSDVAIESVMITDEEEIRTTNPVATEQYGSVSTNLQAGNAQAATADVN

SEQ ID NO: 6326 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGDGHPTKSRLVFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6327 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQKPHSPAAVSEVT

SEQ ID NO: 6328 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGNATTSRLQFSQAGASDIRDQSRNWLPGPCYRQQRVSTQSTGNNNSEYSWTGATKYHLNGRDSLVNPGPAMASHKDDEEKFFPQSGVLIFGKEGSKKGDADIESVMITDEEEIRTTNPVATEQYGSVSTNLQAGNAQAATADVN

SEQ ID NO: 6329 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKEGTKGSNAEFEGVMITDEEEIRTTNPVATEQYGSVSTNLQAGNAQAATADVN

SEQ ID NO: 6330 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPADNNNSDFSWTGATKYHLNGRDSLVNPGPAMASHKDDEGKFFPQSGVLIFGKQGSEKTNVDIEKVMITDEEEIRTTNPVATEQYGSVSTNLQRGNRQAATADVN

SEQ ID NO: 6331 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGSGKNNADIEKVMITDEEEIRTTNPVATEQYGSVSTNLQAGNAQAATADVN

SEQ ID NO: 6332 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSSDNNNSEFSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 6333 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLRFSQAGASDIRDQSRNWLPGPCYRQQRVSKQANHNNNSEFSWTGATTYHLNGRDSLVNPGPAMASHEDDTEKFFPQSGVLIFGKQGSEKTNVDIEKVMITDEEEIRTTNPVATEQYGSVSTNLQAGNAQAATADVN

SEQ ID NO: 6334 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDRFFPQSGVLIFGKQGTEGNDIDIGNVMITDEEEIRTTNPVATEQYGSVSTNLQAGNAQAATADVN

SEQ ID NO: 6335 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGIVTLSGLRFSQAGASDIRDQSRNWLPGPCYRQQRVSKTDGENNNSDFSWTGATKYHLNGRDSLVNPGPAMASHKDDEEKFFPQSGVLIFGKEGGAKNNVAIEHVMITDEEEIRTTNPVATEQYGSVSTNLQAGNAQAATADVN

SEQ ID NO: 6336 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKENATASDVDIGSVMITDEEEIRTTNPVATEQYGSVSTNLQAGNAQAATADVN

SEQ ID NO: 6337 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6338 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDDVMITDEEEIRTTNPVATEQYGSVSTNLQAGNAQAATADVN

SEQ ID NO: 6339 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNDGAAATDVA

SEQ ID NO: 6340 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6341 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHEDDDDKFFPQSGVLIFGKQGSEKTNVDIEKVMITDEEEIRTTNPVATEQYGSVSTNLQAGNAQAATADVN

SEQ ID NO: 6342 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQSGRKNNTDIGDVMITDEEEIRTTNPVATEQYGSVSTNLQAGNAQAATADVN

SEQ ID NO: 6343 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKPDQNNNSEFSWTGATTYHLNGRDSLVNPGPAMASHKDDNEKFFPQSGVLIFGKENAGRADVAFDKVMITDEEEIRTTNPVATEQYGSVSTNLQAGNAQAATADVN

SEQ ID NO: 6344 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSADNNNSDFSWTGATKYHLNGRDSLVNPGPAMASHKDDADKFFPQSGVLIFGKQNAAENDVDIGEVMITDEEEIRTTNPVATEQYGSVSTNLQAGNAQAATADVN

SEQ ID NO: 6345 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTSKDNVAFDQVMITDEEEIRTTNPVATEQYGSVSTNLQAGNAQAATADVN

SEQ ID NO: 6346 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDAEKFFPQSGVLIFGKEGSAKADADIGDVMITDEEEIRTTNPVATEQYGSVSTNLQAGNAQAATADVN

SEQ ID NO: 6347 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAAGADTDIESVMITDEEEIRTTNPVATEQYGSVSTNLQRGNRQAATADVN

SEQ ID NO: 6348 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNNTTSGLQFSQAGASDIRDQSRNWLPGPCYRQQRVSKTSADNNNSEYSWTGATKYHLNGRDSLVNPGPAMASHKDDEEKFFPQSGVLIFGKENAGKNDVEIDHVMITDEEEIRTTNPVATEQYGSVSTNLQAGNAQAATADVN

SEQ ID NO: 6349 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKEGARGGDADFEQVMITDEEEIRTTNPVATEQYGSVSTNLQAGNAQAATADVN

SEQ ID NO: 6350 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6351 - protein, 334 aa, Artificial Sequence; identical to SEQ ID NO: 4513
  Synthetic

SEQ ID NO: 6352 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGSGSNTMSRLKFSQAGASDIRDQSRNWLPGPCYRQQRVSKTSGDNNNSDFSWTGATKYHLNGRDSLVNPGPAMASHGDDADRFFPQSGVLIFGKQNAAKANVDIGDVMITDEEEIRTTNPVATEQYGSVSTNLQAGNAQAATADVN

SEQ ID NO: 6353 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGAGRADIEVGSVMITDEEEIRTTNPVATEQYGSVSTNLQAGNAQAATADVN

SEQ ID NO: 6354 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKTDGENNNSDFSWTGATKYHLNGRDSLVNPGPAMASHKDDEEKFFPQSGVLIFGKEGAGANDVAYENVMITDEEEIRTTNPVATEQYGSVSTNLQAGNAQAATADVN

SEQ ID NO: 6355 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTRSRLQFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6356 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDDDKFFPQSGVLIFGKESAAKDNVEIGDVMITDEEEIRTTNPVATEQYGSVSTNLQAGNAQAATADVN

SEQ ID NO: 6357 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNARAGLTTLSQLGFSQAGASDIRDQSRNWLPGPCYRQQRVSKTSNGNNNSEFSWTGATKYHLNGRDSLVNPGPAMASHRDDEGRFFPQSGVLIFGKQGSEKTNVDIEKVMITDEEEIRTTNPVATEQYGSVSTNLQAGNAQAATADVN

SEQ ID NO: 6358 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKEGAGGNNVDFGEVMITDEEEIRTTNPVATEQYGSVSTNLQAGNAQAATADVN

SEQ ID NO: 6359 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6360 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQSTAESNIHIDGVMITDEEEIRTTNPVATEQYGSVSTNLQAGNAQAATADVN

SEQ ID NO: 6361 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGQNNNSDFSWTGATKYHLNGRDSLVNPGPAMASHKDDEGKFFPQSGVLIFGKEGAGADNVAVGEVMITDEEEIRTTNPVATEQYGSVSTNLQAGNAQAATADVN

SEQ ID NO: 6362 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKEDAGRNDVAFDHVMITDEEEIRTTNPVATEQYGSVSTNLQAGNAQAATADVN

SEQ ID NO: 6363 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQGPHAGAAFDTVA

SEQ ID NO: 6364 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDSGGNMTHSALRFSQAGASDIRDQSRNWLPGPCYRQQRVSKQSDHNNNSNFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6365 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDKFFPQSGVLIFGKEGSRADDVEIEQVMITDEEEIRTTNPVATEQYGSVSTNLQAGNAQAATADVN

SEQ ID NO: 6366 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSAASNADVGQVMITDEEEIRTTNPVATEQYGSVSTNLQAGNAQAATADVN

SEQ ID NO: 6367 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNGGTDTMSGLRFSQAGASDIRDQSRNWLPGPCYRQQRVSKKDSRNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6368 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKQPNDNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6369 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLQFSQAGASDIRDQSRNWLPGPCYRQQRVSKTHGDNNNSNFSWTGATTYHLNGRDSLVNPGPAMASHKDDAEKFFPQSGVLIFGKQGAGKSDVEVGKVMITDEEEIRTTNPVATEQYGSVSTNLQAGNAQAATADVN

SEQ ID NO: 6370 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSNFSWTGATTYHLNGRDSLVNPGPAMASHRDDTDRFFPQSGVLIFGKQGSEKTNVDIEKVMITDEEEIRTTNPVATEQYGSVSTNLQRGNRQAATADVN

SEQ ID NO: 6371 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 6372 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTDARNNNSNFSWTGATKYHLNGRDSLVNPGPAMASHKDDEEKFFPQSGVLIFGKQGANAGNADVEQVMITDEEEIRTTNPVATEQYGSVSTNLQAGNAQAATADVN

SEQ ID NO: 6373 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQGAKANDVDIGSVMITDEEEIRTTNPVATEQYGSVSTNLQAGNAQAATADVN

SEQ ID NO: 6374 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSETTSRLRFSQAGASDIRDQSRNWLPGPCYRQQRVSTQYTDNNNSNFSWTGATTYHLNGRDSLVNPGPAMASHRDDADKFFPQSGVLIFGKQSAGANNVEIESVMITDEEEIRTTNPVATEQYGSVSTNLQAGNAQAATADVN

SEQ ID NO: 6375 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGTGASNADIDHVMITDEEEIRTTNPVATEQYGSVSTNLQAGNAQAATADVN

SEQ ID NO: 6376 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKTADHNNNSDFSWTGATKYHLNGRDSLVNPGPAMASHEDDADKFFPQSGVLIFGKQSADAGNVAIESVMITDEEEIRTTNPVATEQYGSVSTNLQAGNAQAATADVN

SEQ ID NO: 6377 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQPSQNNNSNFSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 6378 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGSEKTNVDIEKVMITDEEEIRTTNPVATEQYGSVSTNLQRGNRQAATADVN

SEQ ID NO: 6379 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6380 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEADNAAFEKVMITDEEEIRTTNPVATEQYGSVSTNLQAGNAQAATADVN

SEQ ID NO: 6381 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDPKTAAAVRGVN

SEQ ID NO: 6382 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6383 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKQSSDNNNSEFSWTGATKYHLNGRDSLVNPGPAMASHEDDNEKFFPQSGVLIFGKEDAKGNDVAIENVMITDEEEIRTTNPVATEQYGSVSTNLQAGNAQAATADVN

SEQ ID NO: 6384 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEDGNGSDTDIDSVMITDEEEIRTTNPVATEQYGSVSTNLQAGNAQAATADVN

SEQ ID NO: 6385 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDEAGRQTTSNLLFSQAGASDIRDQSRNWLPGPCYRQQRVSKTSADNNNSNFSWTGATKYHLNGRDSLVNPGPAMASHRDDEDKFFPQSGVLIFGKQGASETNVEIDKVMITDEEEIRTTNPVATEQYGSVSTNLQAGNAQAATADVN

SEQ ID NO: 6386 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNDNSEFSWTGATKYHLNGRDSLVNPGPAMASHKDDEEKFFPQSGVLIFGKQGSEKTNVDIEKVMITDEEEIRTTNPVATEQYGSVSTNLQAARDGAATTVVH

SEQ ID NO: 6387 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDEGKFFPQSGVLIFGKQNASENNVDFDRVMITDEEEIRTTNPVATEQYGSVSTNLQRGNRQAATADVN

SEQ ID NO: 6388 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGHNNNSNFSWTGATTYHLNGRDSLVNPGPAMASHKDDDEKFFPQSGVLIFGKQGSEKTNVDIEKVMITDEEEIRTTNPVATEQYGSVSTNLQGPQGRAASRDVA

SEQ ID NO: 6389 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGSGIKTKSDLRFSQAGASDIRDQSRNWLPGPCYRQQRVSKQSGDNNNSNFSWTGATTYHLNGRDSLVNPGPAMASHKDDNGRFFPQSGVLIFGKQGSEKTNVDIEKVMITDEEEIRTTNPVATEQYGSVSTNLQAGNAQAATADVN

SEQ ID NO: 6390 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKPHDDNNNSDFSWTGATTYHLNGRDSLVNPGPAMASHKDDDGKFFPQSGVLIFGKQGSEKTNVDIEKVMITDEEEIRTTNPVATEQYGSVSTNLQRGNRQAATADVN

SEQ ID NO: 6391 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGRNTTSTLLFSQAGASDIRDQSRNWLPGPCYRQQRVSKTDDGNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6392 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQDRRSAAAYTTVQ

SEQ ID NO: 6393 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEDAGGSNAEYDKVMITDEEEIRTTNPVATEQYGSVSTNLQAGNAQAATADVN

SEQ ID NO: 6394 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTAKDAAAFARVE

SEQ ID NO: 6395 - protein, 334 aa, Artificial Sequence; identical to SEQ ID NO: 2331
  Synthetic

SEQ ID NO: 6396 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGAGKTNIAYGNVMITDEEEIRTTNPVATEQYGSVSTNLQAGNAQAATADVN

SEQ ID NO: 6397 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFLWTGATKYHLNGRDSLVNPGPAMASHKDDEEKFFPQSGVLIFGKQGSEKTNVDIEKVMITDEEEIRTTNPVATEQYGSVSTNLQGARAQAAISGVQ

SEQ ID NO: 6398 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGSGNQTNSALGFSQAGASDIRDQSRNWLPGPCYRQQRVSTKATDNNNSDFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6399 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTKTLSRLGFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6400 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATKYHLNGRDSLVNPGPAMASHKDDEEKFFPQSGVLIFGKQGSEKTNVDIEKVMITDEEEIRTTNPVATEQYGSVSTNLQGGQSPAADGAVT

SEQ ID NO: 6401 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGTGILTTSALKFSQAGASDIRDQSRNWLPGPCYRQQRVSTKPSDNNNSDFSWTGATTYHLNGRDSLVNPGPAMASHKDDDGKFFPQSGVLIFGKEGAGKANVEFERVMITDEEEIRTTNPVATEQYGSVSTNLQAGNAQAATADVN

SEQ ID NO: 6402 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQSGATGNAAIGEVMITDEEEIRTTNPVATEQYGSVSTNLQAGNAQAATADVN

SEQ ID NO: 6403 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTQRNTAAVAEVH

SEQ ID NO: 6404 - protein, 334 aa, Artificial Sequence; identical to SEQ ID NO: 3834
  Synthetic

SEQ ID NO: 6405 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPQGRAASRDVA

SEQ ID NO: 6406 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNDNSEYSWTGATKYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 6407 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPTGINTTSRLHFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6408 - protein, 334 aa, Artificial Sequence; identical to SEQ ID NO: 2443
  Synthetic

SEQ ID NO: 6409 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEGRFFPQSGVLIFGKQGGEKADVAIDEVMITDEEEIRTTNPVATEQYGSVSTNLQAGNAQAATADVN

SEQ ID NO: 6410 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGERASAAIDDVQ

SEQ ID NO: 6411 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRTTPSALKFSQAGASDIRDQSRNWLPGPCYRQQRVSKQPNQNNNSNFSWTGATTYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 6412 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6413 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKQGSNRADVEIEQVMITDEEEIRTTNPVATEQYGSVSTNLQAGNAQAATADVN

SEQ ID NO: 6414 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAETDNAAFEKVMITDEEEIRTTNPVATEQYGSVSTNLQAGNAQAATADVN

SEQ ID NO: 6415 - protein, 334 aa, Artificial Sequence; identical to SEQ ID NO: 1081
  Synthetic

SEQ ID NO: 6416 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNANGGNVTQSGLRFSQAGASDIRDQSRNWLPGPCYRQQRVSTQADRNNNSNFSWTGATTYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6417 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSARGPAAAQGVQ

SEQ ID NO: 6418 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6419 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGSITTSGLMFSQAGASDIRDQSRNWLPGPCYRQQRVSKPPNGNNNSDFSWTGATTYHLNGRDSLVNPGPAMASHKDDEGKFFPQSGVLIFGKENAAANNADYESVMITDEEEIRTTNPVATEQYGSVSTNLQAGNAQAATADVN

SEQ ID NO: 6420 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKTGLMTTSNLRFSQAGASDIRDQSRNWLPGPCYRQQRVSTQPNHNNNSEFSWTGATKYHLNGRDSLVNPGPAMASHKDDDDRFFPQSGVLIFGKQDAGKANIDIDGVMITDEEEIRTTNPVATEQYGSVSTNLQAGNAQAATADVN

SEQ ID NO: 6421 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSEYSWTGATKYHLNGRDSLVNPGPAMASHKDDDEKFFPQSGVLIFGKEGTAETNIDIEKVMITDEEEIRTTNPVATEQYGSVSTNLQAGNAQAATADVN

SEQ ID NO: 6422 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGSTTHSKLGFSQAGASDIRDQSRNWLPGPCYRQQRVSKTYNDNNNSEFSWTGATTYHLNGRDSLVNPGPAMASHKDDDERFFPQSGVLIFGKQGASAADVEIEDVMITDEEEIRTTNPVATEQYGSVSTNLQAGNAQAATADVN

SEQ ID NO: 6423 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSAGGTLTHSRLKFSQAGASDIRDQSRNWLPGPCYRQQRVSKTSADNNNSNFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 6424 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEESFFPQSGVLIFGKQGSEKTNVDIEKVMITDEEEIRTTNPVATEQYGSVSTNLQGPHGPAADGMVN

SEQ ID NO: 6425 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSTTGHATLSTLKFSQAGASDIRDQSRNWLPGPCYRQQRVSKTYNHNNNSEFSWTGATKYHLNGRDSLVNPGPAMASHKDDEDKFFPQSGVLIFGKQDAAGNNVAIEEVMITDEEEIRTTNPVATEQYGSVSTNLQAGNAQAATADVN

SEQ ID NO: 6426 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQNSSGNDIEIDQVMITDEEEIRTTNPVATEQYGSVSTNLQAGNAQAATADVN

SEQ ID NO: 6427 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGILTQSTLRFSQAGASDIRDQSRNWLPGPCYRQQRVSKQASDNNNSNFSWTGATTYHLNGRDSLVNPGPAMASHKDDEGRFFPQSGVLIFGKQDAGATDVEVDEVMITDEEEIRTTNPVATEQYGSVSTNLQRGNRQAATADVN

SEQ ID NO: 6428 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNRSGNTTISTLGFSQAGASDIRDQSRNWLPGPCYRQQRVSKQHNHNNNSDFSWTGATKYHLNGRDSLVNPGPAMASHKDDEGKFFPQSGVLIFGKESAGAANVAYEDVMITDEEEIRTTNPVATEQYGSVSTNLQAGNAQAATADVN

SEQ ID NO: 6429 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDAGRFFPQSGVLIFGKEGSGKSDAAIGDVMITDEEEIRTTNPVATEQYGSVSTNLQAGNAQAATADVN

SEQ ID NO: 6430 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHRDDTDRFFPQSGVLIFGKQGSEKTNVDIEKVMITDEEEIRTTNPVATEQYGSVSTNLQAGNAQAATADVN

SEQ ID NO: 6431 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKKYTDNNNSDFSWTGATKYHLNGRDSLVNPGPAMASHKDDNEKFFPQSGVLIFGKEDAAKTNAAVDQVMITDEEEIRTTNPVATEQYGSVSTNLQAGNAQAATADVN

SEQ ID NO: 6432 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKGGTLTNSRLRFSQAGASDIRDQSRNWLPGPCYRQQRVSKTDGENNNSDFSWTGATKYHLNGRDSLVNPGPAMASHKDDEEKFFPQSGVLIFGKEGTGANNAEIGEVMITDEEEIRTTNPVATEQYGSVSTNLQAGNAQAATADVN

SEQ ID NO: 6433 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6434 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQADRNGAAVRMVT

SEQ ID NO: 6435 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGLQTHSRLQFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 6436 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSAGNNNSNFSWTGATKYHLNGRDSLVNPGPAMASHKDDDEKFFPQSGVLIFGKEGSRKNNAEFGEVMITDEEEIRTTNPVATEQYGSVSTNLQAGNAQAATADVN

SEQ ID NO: 6437 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDDDRFFPQSGVLIFGKQNTNEGNIAIDEVMITDEEEIRTTNPVATEQYGSVSTNLQAGNAQAATADVN

SEQ ID NO: 6438 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTAAANADIDGVMITDEEEIRTTNPVATEQYGSVSTNLQAGNAQAATADVN

SEQ ID NO: 6439 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATTYHLNGRDSLVNPGPAMASHKDDNEKFFPQSGVLIFGKQDTSANDTDIDGVMITDEEEIRTTNPVATEQYGSVSTNLQAGNAQAATADVN

SEQ ID NO: 6440 - protein, 334 aa, Artificial Sequence; identical to SEQ ID NO: 1097
  Synthetic

SEQ ID NO: 6441 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQGRSASAAVEGVQ

SEQ ID NO: 6442 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQASDNNNSEFSWTGATKYHLNGRDSLVNPGPAMASHKDDEEKFFPQSGVLIFGKESAGKTNVAIGEVMITDEEEIRTTNPVATEQYGSVSTNLQAGNAQAATADVN

SEQ ID NO: 6443 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHRDDEDKFFPQSGVLIFGKQDSNGANTEIGDVMITDEEEIRTTNPVATEQYGSVSTNLQAGNAQAATADVN

SEQ ID NO: 6444 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDGAAFTEVH

SEQ ID NO: 6445 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAGGSATQSHLRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQRGNRQAATADVN

SEQ ID NO: 6446 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSNFSWTGATKYHLNGRDSLVNPGPAMASHKDDNDKFFPQSGVLIFGKQGSTGTNTDIGQVMITDEEEIRTTNPVATEQYGSVSTNLQAGNAQAATADVN

SEQ ID NO: 6447 - protein, 334 aa, Artificial Sequence; identical to SEQ ID NO: 840
  Synthetic

SEQ ID NO: 6448 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEEKFFPQSGVLIFGKQDTSTNNVEIEGVMITDEEEIRTTNPVATEQYGSVSTNLQAGNAQAATADVN

SEQ ID NO: 6449 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKQPNDNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6450 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGTQTTSTLGFSQAGASDIRDQSRNWLPGPCYRQQRVSKQSADNNNSDFSWTGATKYHLNGRDSLVNPGPAMASHKDDADKFFPQSGVLIFGKQGSEKTNVDIEKVMITDEEEIRTTNPVATEQYGSVSTNLQAGNAQAATADVN

SEQ ID NO: 6451 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKDDRNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6452 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6453 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAAGTNAAIERVMITDEEEIRTTNPVATEQYGSVSTNLQAGNAQAATADVN

SEQ ID NO: 6454 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSTKAGENNNSNFSWTGATTYHLNGRDSLVNPGPAMASHRDDEEKFFPQSGVLIFGKQGSEKTNVDIEKVMITDEEEIRTTNPVATEQYGSVSTNLQGGQSPAADGAVT

SEQ ID NO: 6455 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQGRSASAAVEGVQ

SEQ ID NO: 6456 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 6457 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGHETLSRLMFSQAGASDIRDQSRNWLPGPCYRQQRVSKTDGENNNSDFSWTGATKYHLNGRDSLVNPGPAMASHKDDEEKFFPQSGVLIFGKEGAAASDVEYGEVMITDEEEIRTTNPVATEQYGSVSTNLQAGNAQAATADVN

SEQ ID NO: 6458 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDKEKFFPQSGVLIFGKQGGSATNIDIGGVMITDEEEIRTTNPVATEQYGSVSTNLQAGNAQAATADVN

SEQ ID NO: 6459 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGTAETNVEIEEVMITDEEEIRTTNPVATEQYGSVSTNLQAGNAQAATADVN

SEQ ID NO: 6460 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 6461 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDEKFFPQSGVLIFGKESSAGGDAAFDQVMITDEEEIRTTNPVATEQYGSVSTNLQAGNAQAATADVN

SEQ ID NO: 6462 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDSEKTNVDIEKVMITDEEEIRTTNPVATEQYGSVSTNLQAGNAQAATADVN

SEQ ID NO: 6463 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASTGPITKSQLKFSQAGASDIRDQSRNWLPGPCYRQQRVSTQSTHNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6464 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKERGTKANADIGHVMITDEEEIRTTNPVATEQYGSVSTNLQAGNAQAATADVN

SEQ ID NO: 6465 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGTNTMSTLQFSQAGASDIRDQSRNWLPGPCYRQQRVSKTYNDNNNSEFSWTGATKYHLNGRDSLVNPGPAMASHGDDNDRFFPQSGVLIFGKQGSEKTNVDIEKVMITDEEEIRTTNPVATEQYGSVSTNLQRGNRQAATADVN

SEQ ID NO: 6466 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPAGIATMSTLRFSQAGASDIRDQSRNWLPGPCYRQQRVSKTDGENNNSDFSWTGATKYHLNGRDSLVNPGPAMASHEDDNDKFFPQSGVLIFGKEGARGADIDIGDVMITDEEEIRTTNPVATEQYGSVSTNLQAGNAQAATADVN

SEQ ID NO: 6467 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDAENNNSEFSWPGATEYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 6468 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6469 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQNAEASNADIDRVMITDEEEIRTTNPVATEQYGSVSTNLQAGNAQAATADVN

SEQ ID NO: 6470 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTTGTVTMSTLEFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6471 - protein, 334 aa, Artificial Sequence; identical to SEQ ID NO: 1350
  Synthetic

SEQ ID NO: 6472 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKQGSEKTNVDIEKVMITDEEEIRTTNPVATEQYGSVSTNLQAGNAQAATADAN

SEQ ID NO: 6473 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDHNNNSNFSWTGATKYHLNGRDSLVNPGPAMASHKDDDDKFFPQSGVLIFGKEGAGANDVAYENVMITDEEEIRTTNPVATEQYGSVSTNLQAGNAQAATADVN

SEQ ID NO: 6474 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNANGGHLTKSKLSFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 6475 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHTGRTTMSGLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6476 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNTGSKTLSRLKFSQAGASDIRDQSRNWLPGPCYRQQRVSTTPSHNNNSDFSWTGATTYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6477 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6478 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQPSQNNNSNFSWTGATKYHLNGRDSLVNPGPAMASHEDDTGRFFPQSGVLIFGKEGGAGADVDIGQVMITDEEEIRTTNPVATEQYGSVSTNLQAGNAQAATADVN

SEQ ID NO: 6479 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKTSADNNNSEYSWTGATKYHLNGRDSLVNPGPAMASHKDDDDKFFPQSGVLIFGKEGTRKNNVDIEQVMITDEEEIRTTNPVATEQYGSVSTNLQAGNAQAATADVN

SEQ ID NO: 6480 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6481 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQSSDNNNSDFSWTGATKYHLNGRDSLVNPGPAMASHKDDDDKFFPQSGVLIFGKESSGKADVEFGEVMITDEEEIRTTNPVATEQYGSVSTNLQAGNAQAATADVN

SEQ ID NO: 6482 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQPSQNNDSNFSWTGATKYHLNGRDSLVNPGPAMASHEDDTGRFFPQSGVLIFGKQGSEKTNVDIEKVMITDEEEIRTTNPVATEQYGSVSTNLQRGNRQAATADVN

SEQ ID NO: 6483 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTATGSNTISQLRFSQAGASDIRDQSRNWLPGPCYRQQRVSKTSADNNNSEYSWTGATKYHLNGRDSLVNPGPAMASHKDDEEKFFPQSGVLIFGKQGSETTDTEFDSVMITDEEEIRTTNPVATEQYGSVSTNLQAGNAQAATADVN

SEQ ID NO: 6484 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAASAGAAYNNVA

SEQ ID NO: 6485 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGPMTTSSLKFSQAGASDIRDQSRNWLPGPCYRQQRVSKTSADNNNSEYSWTGATEYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6486 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQTTQSQAAIHAVA

SEQ ID NO: 6487 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKTGSLTQSGLRFSQAGASDIRDQSRNWLPGPCYRQQRVSTQHTENNNSDFSWTGATKYHLNGRDSLVNPGPAMASHRDDDDKFFPQSGVLIFGKQGATKDDVDFDGVMITDEEEIRTTNPVATEQYGSVSTNLQAGNAQAATADVN

SEQ ID NO: 6488 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPSQNNNSNFSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 6489 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGTGRANVAIEGVMITDEEEIRTTNPVATEQYGSVSTNLQAGNAQAATADVN

SEQ ID NO: 6490 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEDGNGSDTDIDSVMITDEEEIRTTNPVATEQYGSVSTNLQAGNAQAATADVN

SEQ ID NO: 6491 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGNPTMSELRFSQAGASDIRDQSRNWLPGPCYRQQRVSKTSTENNNSEFSWTGATKYHLNGRDSLVNPGPAMASHKDDDEKFFPQSGVLIFGKEGTTGTDAEIDNVMITDEEEIRTTNPVATEQYGSVSTNLQAGNAQAATADVN

SEQ ID NO: 6492 - protein, 334 aa, Artificial Sequence
  Synthetic
ATGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDDERFFPQSGVLIFGKESATGDNVEIGQVMITDEEEIRTTNPVATEQYGSVSTNLQAGNAQAATADVN

SEQ ID NO: 6493 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPANGNNNSEFSWTGATKYHLNGRDSLVNPGPAMASHKDDNDKFFPQSGVLIFGKEGTDKTNADIDNVMITDEEEIRTTNPVATEQYGSVSTNLQAGNAQAATADVN

SEQ ID NO: 6494 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQSAKGGNVEYGDVMITDEEEIRTTNPVATEQYGSVSTNLQAGNAQAATADVN

SEQ ID NO: 6495 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGRFFPQSGVLIFGKQGSEKTNVDIEKVMITDEEEIRTTNPVATEQYGSVSTNLQRGNRQAATADVN

SEQ ID NO: 6496 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSRATAAFDEVN

SEQ ID NO: 6497 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKEDAARTDVAIDKVMITDEEEIRTTNPVATEQYGSVSTNLQAGNAQAATADVN

SEQ ID NO: 6498 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTDATNVAVDQVMITDEEEIRTTNPVATEQYGSVSTNLQRGNRQAATADVN

SEQ ID NO: 6499 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAAGITTMSGLRFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6500 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDDVMITDEEEIRTTNPVATEQYGSVSTNLQAGNAQAATADVN

SEQ ID NO: 6501 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKQSDHNNNSNFSWTGATKYHLNGRDSLVNPGPAMASHKDDDDKFFPQSGVLIFGKQGTKKTNAEIEDVMITDEEEIRTTNPVATEQYGSVSTNLQRGNRQAATADVN

SEQ ID NO: 6502 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQTGPTTLSQLRFSQAGASDIRDQSRNWLPGPCYRQQRVSTQPARNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6503 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDEGKFFPQSGVLIFGKQGSEKTNVDIEKVMITDEEEIRTTNPVATEQYGSVSTNLQRGNRQAATADVN

SEQ ID NO: 6504 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRVTLSNLGFSQAGASDIRDQSRNWLPGPCYRQQRVSKQPNDNNNSEFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6505 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEDSNGNNIAIDKVMITDEEEIRTTNPVATEQYGSVSTNLQAGNAQAATADVN

SEQ ID NO: 6506 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 6507 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSGRNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6508 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNETKSGLVFSQAGASDIRDQSRNWLPGPCYRQQRVSKQPNDNNNSEFSWPGATKYHLNGRDSLVNPGPAMASHKDDEEKFFPQSGVLIFGKQGAGKNNVEVESVMITDEEEIRTTNPVATEQYGSVSTNLQAGNAQAATADVN

SEQ ID NO: 6509 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDSAASNVEFGQVMITDEEEIRTTNPVATEQYGSVSTNLQAGNAQAATADVN

SEQ ID NO: 6510 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6511 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGPGGHATTSGLRFSQAGASDIRDQSRNWLPGPCYRQQRVSKQSGQNNNSDFSWTGATKYHLNGRDSLVNPGPAMASHRDDEDKFFPQSGVLIFGKQDGTGANVEIEEVMITDEEEIRTTNPVATEQYGSVSTNLQAGNAQAATADVN

SEQ ID NO: 6512 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGQHGPAASNAVH

SEQ ID NO: 6513 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDNSGTQTNSRLRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6514 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQDSRGGAAFSEVN

SEQ ID NO: 6515 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGLTTLSKLGFSQAGASDIRDQSRNWLPGPCYRQQRVSTTANHNNNSDFSWTGATKYHLNGRDSLVNPGPAMASHKDDEEKFFPQSGVLIFGKQGAATDNAAIDQVMITDEEEIRTTNPVATEQYGSVSTNLQAGNAQAATADVN

SEQ ID NO: 6516 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTASGNVTQSTLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6517 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHKDDEGKFFPQSGVLIFGKQGSEKTNVDIEKVMITDEEEIRTTNPVATEQYGSVSTNLQGNQTQAATTGVP

SEQ ID NO: 6518 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTGAANTKVD

SEQ ID NO: 6519 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 6520 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKTTWNNNSDFSWTGATKYHLNGRDSLVNPGPAMASHKDDEDKFFPQSGVLIFGKQGSAAANIEIEQVMITDEEEIRTTNPVATEQYGSVSTNLQAGNAQAATADVN

SEQ ID NO: 6521 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6522 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKPPNGNNNSEFSWTGATTYHLNGRDSLVNPGPAMASHKDDDDRFFPQSGVLIFGKEGAGGTDVEIDSVMITDEEEIRTTNPVATEQYGSVSTNLQAGNAQAATADVN

SEQ ID NO: 6523 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGSKTTSTLRFSQAGASDIRDQSRNWLPGPCYRQQRVSKQDTDNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6524 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGGRNQAAFAVVA

SEQ ID NO: 6525 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6526 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSDTKSKLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTPAAFDIVA

SEQ ID NO: 6527 - protein, 334 aa, Artificial Sequence
  Synthetic
RSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATTYHLNGRDSLVNPGPAMASHKDDEGKFFPQSGVLIFGKEGGTKNDVDIGGVMITDEEEIRTTNPVATEQYGSVSTNLQAGNAQAATADVN

SEQ ID NO: 6528 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6529 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6530 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6531 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6532 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNRQDGAAVRAVA

SEQ ID NO: 6533 - protein, 334 aa, Artificial Sequence; identical to SEQ ID NO: 449
  Synthetic

SEQ ID NO: 6534 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGTANAEVGEVMITDEEEIRTTNPVATEQYGSVSTNLQAGNAQAATADVN

SEQ ID NO: 6535 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHKDDKEKFFPQSGVLIFGKQGSEKTNVDIEKVMITDEEEIRTTNPVATEQYGSVSTNLQAGNAQAATADVN

SEQ ID NO: 6536 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHRDDEDKFFPQSGVLIFGKQDATATNADYEHVMITDEEEIRTTNPVATEQYGSVSTNLQAGNAQAATADVN

SEQ ID NO: 6537 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQSADNNNSDFSWTGATKYHLNGRDSLVNPGPAMASHKDDADKFFPQSGVLIFGKQGAGGADIEFDQVMITDEEEIRTTNPVATEQYGSVSTNLQAGNAQAATADVN

SEQ ID NO: 6538 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6539 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDADTTNTEIEHVMITDEEEIRTTNPVATEQYGSVSTNLQAGNAQAATADVN

SEQ ID NO: 6540 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHRDDEDKFFPQSGVLIFGKESGTTSNVDIGGVMITDEEEIRTTNPVATEQYGSVSTNLQAGNAQAATADVN

SEQ ID NO: 6541 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSSSGNMTTSTLLFSQAGASDIRDQSRNWLPGPCYRQQRVSTTSSENNNSNFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6542 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGTTTKSALRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6543 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKIHRNNNSDFSWTGATKYHLNGRDSLVNPGPAMASHGDDNDKFFPQSGVLIFGKQGSEKTNVDIEKVMITDEEEIRTTNPVATEQYGSVSTNLQAGNAQAATADVN

SEQ ID NO: 6544 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRHTRAAAEAVE

SEQ ID NO: 6545 - protein, 334 aa, Artificial Sequence
  Synthetic
QSGSSNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSKYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6546 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGNDTTSRLKFSQAGASDIRDQSRNWLPGPCYRQQRVSKQPNDNNNSEFSWTGATTYHLNGRDSLVNPGPAMASHKDDADRFFPQSGVLIFGKQDSGRANVDFEKVMITDEEEIRTTNPVATEQYGSVSTNLQAGNAQAATADVN

SEQ ID NO: 6547 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGTKKTNAEIEDVMITDEEEIRTTNPVATEQYGSVSTNLQRGNRQAATADVN

SEQ ID NO: 6548 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARQAGAAFDSVN

SEQ ID NO: 6549 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGIMTTSTLRFSQAGASDIRDQSRNWLPGPCYRQQRVSKTSADNNNSNFSWTGATKYHLNGRDSLVNPGPAMASHRDDEDKFFPQSGVLIFGKQDAGKSNADIDRVMITDEEEIRTTNPVATEQYGSVSTNLQAGNAQAATADVN

SEQ ID NO: 6550 - protein, 334 aa, Artificial Sequence; identical to SEQ ID NO: 4115
  Synthetic

SEQ ID NO: 6551 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGARGADAEIESVMITDEEEIRTTNPVATEQYGSVSTNLQAGNAQAATADVN

SEQ ID NO: 6552 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTGNNNSDFSWTGATKYHLNGRDSLVNPGPAMASHKDDEEKFFPQSGVLIFGKQNGGAADAEIEHVMITDEEEIRTTNPVATEQYGSVSTNLQAGNAQAATADVN

SEQ ID NO: 6553 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTNTQSGLRFSQAGASDIRDQSRNWLPGPCYRQQRVSKQSADNNNSDFSWTGATKYHLNGRDSLVNPGPAMASHKDDADKFFPQSGVLIFGKQNAAENDVDIGEVMITDEEEIRTTNPVATEQYGSVSTNLQAGNAQAATADVN

SEQ ID NO: 6554 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTGKFFPQSGVLIFGKQGSEKTNVDIEKVMITDEEEIRTTNPVATEQYGSVSTNLQRGNRQAATADVN

SEQ ID NO: 6555 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEGGGGSDVEFDGVMITDEEEIRTTNPVATEQYGSVSTNLQAGNAQAATADVN

SEQ ID NO: 6556 - protein, 334 aa, Artificial Sequence; identical to SEQ ID NO: 4477
  Synthetic

SEQ ID NO: 6557 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRRNNGAAYAGVD

SEQ ID NO: 6558 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNESGSDTHSRLKFSQAGASDIRDQSRNWLPGPCYRQQRVSKQSDRNNNSEFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6559 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAKGNAASGDVT

SEQ ID NO: 6560 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSSSGSVTPSDLHFSQAGASDIRDQSRNWLPGPCYRQQRVSKQPGDNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6561 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNNTQSGLRFSQAGASDIRDQSRNWLPGPCYRQQRVSKQHNQNNNSEFSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 6562 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQASDNNNSEFSWTGATTYHLNGRDSLVNPGPAMASHKDDNDKFFPQSGVLIFGKQNTGRTNAAIEQVMITDEEEIRTTNPVATEQYGSVSTNLQAGNAQAATADVN

SEQ ID NO: 6563 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKQANHNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6564 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRSGTVTPSGLMFSQAGASDIRDQSRNWLPGPCYRQQRVSKTPNDNNNSNFSWTGATKYHLNGRDSLVNPGPAMASHEDDAGKFFPQSGVLIFGKQSAKAANAAIDEVMITDEEEIRTTNPVATEQYGSVSTNLQAGNAQAATADVN

SEQ ID NO: 6565 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNITKSPLHFSQAGASDIRDQSRNWLPGPCYRQQRVSTQSTGNNNSDFSWTGATKYHLNGRDSLVNPGPAMASHKDDDDRFFPQSGVLIFGKQGSGKSNVAFGDVMITDEEEIRTTNPVATEQYGSVSTNLQAGNAQAATADVN

SEQ ID NO: 6566 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6567 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKEDATGSNIAIDQVMITDEEEIRTTNPVATEQYGSVSTNLQAGNAQAATADVN

SEQ ID NO: 6568 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTAGGTLTTSNLRFSQAGASDIRDQSRNWLPGPCYRQQRVSKQANHNNNSEFSWTGATTYHLNGRDSLVNPGPAMASHKDDDEKFFPQSGVLIFGKQNTGGTNVDIGQVMITDEEEIRTTNPVATEQYGSVSTNLQAGNAQAATADVN

SEQ ID NO: 6569 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKTPNGNNNSDFSWTGATKYHLNGRDSLVNPGPAMASHKDDDEKFFPQSGVLIFGKQSSSGNNIDIGHVMITDEEEIRTTNPVATEQYGSVSTNLQAGNAQAATADVN

SEQ ID NO: 6570 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDQSGRTTPSSLRFSQAGASDIRDQSRNWLPGPCYRQQRVSKQSDRNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6571 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDRFFPQSGVLIFGKESTARNNADVEQVMITDEEEIRTTNPVATEQYGSVSTNLQAGNAQAATEDVN

SEQ ID NO: 6572 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDDGKFFPQSGVLIFGKQGSEKTNVDIEKVMITDEEEIRTTNPVATEQYGSVSTNLQAGNAQAATADVN

SEQ ID NO: 6573 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSDFSWTGATKYHLNGRDSLVNPGPAMASHKDDDEKFFPQSGVLIFGKQDSGRNNADFDGVMITDEEEIRTTNPVATEQYGSVSTNLQAGNAQAATADVN

SEQ ID NO: 6574 - protein, 334 aa, Artificial Sequence; identical to SEQ ID NO: 737
  Synthetic

SEQ ID NO: 6575 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKAQAADARVQ

SEQ ID NO: 6576 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHAGSKTTSELKFSQAGASDIRDQSRNWLPGPCYRQQRVSKQSSDNNNSEFSWTGATKYHLNGRDSLVNPGPAMASHEDDNEKFFPQSGVLIFGKEDAKGNDVAIENVMITDEEEIRTTNPVATEQYGSVSTNLQAGNAQAATADVN

SEQ ID NO: 6577 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKYDEEKFFPQSGVLIFGKQGSEKTNVDIEKVMITDEEEIRTTNPVATEQYGSVSTNLQGRKNAAAFQNVE

SEQ ID NO: 6578 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6579 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGHPTLSQLKFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6580 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQTRRDPAADNMVT

SEQ ID NO: 6581 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTRATKYHLNGRDSLVNPGPAMASHKDDEEKFFPQSGVLIFGKQGTNESDVDIEKVMITDEEEIRTTNPVATEQYGSVSTNLQRGNRQAATADVN

SEQ ID NO: 6582 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATEIVK

SEQ ID NO: 6583 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDRFFPQSGVLIFGKEGSGGGNVEFEGVMITDEEEIRTTNPVATEQYGSVSTNLQAGNAQAATADVN

SEQ ID NO: 6584 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKEDAGKADVEIGKVMITDEEEIRTTNPVATEQYGSVSTNLQAGNAQAATADVN

SEQ ID NO: 6585 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGNVTKSQLGFSQAGASDIRDQSRNWLPGPCYRQQRVSTTYNHNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6586 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6587 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHEDDNEKFFPQSGVLIFGKQDASGSDVDYERVMITDEEEIRTTNPVATEQYGSVSTNLQAGNAQAATADVN

SEQ ID NO: 6588 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDASGIATLSKLRFSQAGASDIRDQSRNWLPGPCYRQQRVSKQPNDNNNSEFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6589 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGASGSQTHSGLMFSQAGASDIRDQSRNWLPGPCYRQQRVSKPANGNNNSEYSWTGATKYHLNGRDSLVNPGPAMASHKDDEEKFFPQSGVLIFGKQGTGASNVEVENVMITDEEEIRTTNPVATEQYGSVSTNLQAGNAQAATADVN

SEQ ID NO: 6590 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSADNNNSEYSWTGATKYHLNGRDSLVNPGPAMASHKDDAGKFFPQSGVLIFGKQSAKAANAAIDEVMITDEEEIRTTNPVATEQYGSVSTNLQAGNAQAATADVN

SEQ ID NO: 6591 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQDTDNNNSEFSWTGATKYHLNGRDSLVNPGPAMASHKDDEEKFFPQSGVLIFGKQGSEKTNVDIEKVMITDEEEIRTTNPVATEQYGSVSTNLQGGRDEAADRTVN

SEQ ID NO: 6592 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 6593 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPAGNNNSEFSWTGATKYHLNGRDSLVNPGPAMASHRDDDDRFFPQSGVLIFGKQGSEKTNVDIEKVMITDEEEIRTTNPVATEQYGSVSTNLQAGNAQAATADVN

SEQ ID NO: 6594 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGKQGGAANKAVN

SEQ ID NO: 6595 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSDSGNPTHSDLRFSQAGASDIRDQSRNWLPGPCYRQQRVSKTYNDNNNSEFSWTGATTYHLNGRDSLVNPGPAMASHKDDDERFFPQSGVLIFGKENAGRADVAFDKVMITDEEEIRTTNPVATEQYGSVSTNLQAGNAQAATADVN

SEQ ID NO: 6596 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQPSQNNNSNFSWTGATKYHLNGRDSLVNPGPAMASHEDDTGRFFPQSGVLIFGKEGGAGADVDIGQVMITDEEEIRTTNPVATEQYGSVSTNLQAGNAQAATADVN

SEQ ID NO: 6597 - protein, 334 aa, Artificial Sequence; identical to SEQ ID NO: 2759
  Synthetic

SEQ ID NO: 6598 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGSTTPSALKFSQAGASDIRDQSRNWLPGPCYRQQRVSKTHGDNNNSNFSWTGATKYHLNGRDSLVNPGPAMASHKDDEEKFFPQSGVLIFGKEGSEKTNVDIEKVMITDEEEIRTTNPVATEQYGSVSTNLQAGNAQAATADVN

SEQ ID NO: 6599 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTYNDNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6600 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRGGAAFGMVH

SEQ ID NO: 6601 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNADIEKVMITDEEEIRTTNPVATEQYGSVSTNLQAGNAQAATADVN

SEQ ID NO: 6602 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6603 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQGTRGTAAADAVQ

SEQ ID NO: 6604 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGPATKSTLRFSQAGASDIRDQSRNWLPGPCYRQQRVSKTPNDNNNSNFSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 6605 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQARSNRAAFDVVH

SEQ ID NO: 6606 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDEEKFFPQSGVLIFGKEGSEKTNVDIEKVMITDEEEIRTTNPVATEQYGSVSTNLQRGNRQAATADVN

SEQ ID NO: 6607 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLRFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6608 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHRDDEDKFFPQSGVLIFGKQGAEGTNVAYDKVMITDEEEIRTTNPVATEQYGSVSTNLQAGNAQAATADVN

SEQ ID NO: 6609 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGGTDNVDIDRVMITDEEEIRTTNPVATEQYGSVSTNLQAGNAQAATADVN

SEQ ID NO: 6610 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQPSQNNNSNFSWTGATKYHLNGRDSLVNPGPAMASHRDDEGKFFPQSGVLIFGKQSGEKNDVDIDGVMITDEEEIRTTNPVATEQYGSVSTNLQAGNAQAATADVN

SEQ ID NO: 6611 - protein, 334 aa, Artificial Sequence; identical to SEQ ID NO: 1907
  Synthetic

SEQ ID NO: 6612 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKESAGANNVDIGGVMITDEEEIRTTNPVATEQYGSVSTNLQAGNAQAATADVN

SEQ ID NO: 6613 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKESTGGNNVAVGQVMITDEEEIRTTNPVATEQYGSVSTNLQAGNAQAATADVN

SEQ ID NO: 6614 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKTSADNNNSEYSWTGATKYHLNGRDSLVNPGPAMASHKDDEDKFFPQSGVLIFGKQDGKGSNIAIEGVMITDEEEIRTTNPVATEQYGSVSTNLQAGNAQAATADVN

SEQ ID NO: 6615 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGSGRVTLSNLGFSQAGASDIRDQSRNWLPGPCYRQQRVSKQPNDNNNSEFSWTGATTYHLNGRDSLVNPGPAMASHKDDNEKFFPQSGVLIFGKEGSGASDVAIEQVMITDEEEIRTTNPVATEQYGSVSTNLQRGNRQAATADVN

SEQ ID NO: 6616 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6617 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSDYSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6618 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTASGNVTQSTLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6619 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAKGNNVEVGQVMITDEEEIRTTNPVATEQYGSVSTNLQAGNAQAATADVN

SEQ ID NO: 6620 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6621 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAGKFFPQSGVLIFGKQGSEKTNVDIEKVMITDEEEIRTTNPVATEQYGSVSTNLQAGNAQTATADVN

SEQ ID NO: 6622 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6623 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGHRDQAADKGVD

SEQ ID NO: 6624 - protein, 334 aa, Artificial Sequence; identical to SEQ ID NO: 3468
  Synthetic

SEQ ID NO: 6625 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGRAPAAFSEVN

SEQ ID NO: 6626 - protein, 334 aa, Artificial Sequence; identical to SEQ ID NO: 101
  Synthetic

SEQ ID NO: 6627 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGNTTKSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6628 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGLTTTSELRFSQAGASDIRDQSRNWLPGPCYRQQRVSTQSTGNNNSDFSWTGATKYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6629 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKEGGAEGDVDFDGVMITDEEEIRTTNPVATEQYGSVSTNLQRGNRQAATADVN

SEQ ID NO: 6630 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDEEKFFPQSGVLIFGKQGSEKTNVDIEKVMITDEEEIRTTNPVATEQYGSVSTNLQKPHSPAAVSEVT

SEQ ID NO: 6631 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDRFFPQSGVLIFGKQGSEKTNVDIEKVMITDEEEIRTTNPVATEQYGSVSTNLQAGNAQAATADVN

SEQ ID NO: 6632 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTNRDAAAANTVT

SEQ ID NO: 6633 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKSTGNNNSDFSWTGATKYHLNGRDSLVNPGPAMASHRDDEDRFFPQSGVLIFGKESANKTNIDIEHVMITDEEEIRTTNPVATEQYGSVSTNLQAGNAQAATADVN

SEQ ID NO: 6634 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQSTSATNAAYEDVMITDEEEIRTTNPVATEQYGSVSTNLQAGNAQAATADVN

SEQ ID NO: 6635 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPAGNNNSNFSWTGATKYHLNGRDSLVNPGPAMASHEDDDDRFFPQSGVLIFGKQNAEASNADIDRVMITDEEEIRTTNPVATEQYGSVSTNLQAGNAQAATADVN

SEQ ID NO: 6636 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQNSTANNVDVGSVMITDEEEIRTTNPVATEQYGSVSTNLQAGNAQAATADVN

SEQ ID NO: 6637 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGKSGLATKSNLGFSQAGASDIRDQSRNWLPGPCYRQQRVSKTSADNNNSEYSWTGATKYHLNGRDSLVNPGPAMASHKDDEEKFFPQSGVLIFGKQGAGTTDVEYGQVMITDEEEIRTTNPVATEQYGSVSTNLQAGNAQAATADVN

SEQ ID NO: 6638 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHRDDEDRFFPQSGVLIFGKQDAETSDVDVDRVMITDEEEIRTTNPVATEQYGSVSTNLQAGNAQAATADVN

SEQ ID NO: 6639 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHSGPTTPSSLVFSQAGASDIRDQSRNWLPGPCYRQQRVSKTAGRNNNSDFSWTGATTYHLNGRDSLVNPGPAMASHRDDDEKFFPQSGVLIFGKQDSEKTNVDIEKVMITDEEEIRTTNPVATEQYGSVSTNLQAGNAQAATADVN

SEQ ID NO: 6640 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKESGTANDVDIDRVMITDEEEIRTTNPVATEQYGSVSTNLQAGNAQAATADVN

SEQ ID NO: 6641 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNTAATTNVD

SEQ ID NO: 6642 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDNDRFFPQSGVLIFGKEDSGGVDVEIDRVMITDEEEIRTTNPVATEQYGSVSTNLQRGNRQAATADVN

SEQ ID NO: 6643 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRTMRAGFFPQSGVLIFGKQGSEKTNVDIEKVMITDEEEIRTTNPVATEQYGSVSTNLQAGNAQAATADVN

SEQ ID NO: 6644 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKQSDRNNNSEFSWTGATKYHLNGRDSLVNPGPAMASHKDDEDKFFPQSGVLIFGKQGSNRADVEIEQVMITDEEEIRTTNPVATEQYGSVSTNLQRGNRQAATADVN

SEQ ID NO: 6645 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSDFSWTGATTYHLNGRDSLVNPGPAMASHKDDEEKFFPQSGVLIFGKQGAGANNVAIGDVMITDEEEIRTTNPVATEQYGSVSTNLQAGNAQAATADVN

SEQ ID NO: 6646 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQGTGKDNVAIGGVMITDEEEIRTTNPVATEQYGSVSTNLQAGNAQAATADVN

SEQ ID NO: 6647 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGPQTTSTLRFSQAGASDIRDQSRNWLPGPCYRQQRVSKTYNDNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6648 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGAKGTNVAVEKVMITDEEEIRTTNPVATEQYGSVSTNLQAGNAQAATADVN

SEQ ID NO: 6649 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGIMTTSTLRFSQAGASDIRDQSRNWLPGPCYRQQRVSKTSADNNNSNFSWTGATKYHLNGRDSLVNPGPAMASHRDDEDKFFPQSGVLIFGKQDAGKGNADIDRVMITDEEEIRTTNPVATEQYGSVSTNLQAGNAQAATADVN

SEQ ID NO: 6650 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATTYHLNGRDSLVNPGPAMASHKDDKEKFFPQSGVLIFGKQGGSATNIDIGGVMITDEEEIRTTNPVATEQYGSVSTNLQAGNAQAATADVN

SEQ ID NO: 6651 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDTGKNNVAIERVMITDEEEIRTTNPVATEQYGSVSTNLQAGNAQAATADVN

SEQ ID NO: 6652 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKSGLDTLSTLGFSQAGASDIRDQSRNWLPGPCYRQQRVSKQPNDNNNSEFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6653 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSTLRFSQAGASDIRDQSRNWLPGPCYRQQRVSKTPNDNNNSNFSWTGATKYHLNGRDSLVNPGPAMASHKDDDDKFFPQSGVLIFGKESSAKTNAAYGEVMITDEEEIRTTNPVATEQYGSVSTNLQAGNAQAATADVN

SEQ ID NO: 6654 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQHNQNNNSEFSWTGATTYHLNGRDSLVNPGPAMASHKDDDEKFFPQSGVLIFGKQDGARDDAAIEDVMITDEEEIRTTNPVATEQYGSVSTNLQAGNAQAATADVN

SEQ ID NO: 6655 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPKSRAADDVVT

SEQ ID NO: 6656 - protein, 334 aa, Artificial Sequence
  Synthetic
CAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 6657 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGGGIVTLSGLRFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6658 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6659 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQDGGGSNAAFDEVMITDEEEIRTTNPVATEQYGSVSTNLQAGNAQAATADVN

SEQ ID NO: 6660 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGAHDGAAARGVQ

SEQ ID NO: 6661 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDGGLATKSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6662 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKDSRNNNSDFSWTGATTYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6663 - protein, 334 aa, Artificial Sequence; identical to SEQ ID NO: 4151
  Synthetic

SEQ ID NO: 6664 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAHAGSHTMSSLRFSQAGASDIRDQSRNWLPGPCYRQQRVSKTDGENNNSDFSWTGATKYHLNGRDSLVNPGPAMASHKDDEEKFFPQSGVLIFGKEGAAKDDVAVEKVMITDEEEIRTTNPVATEQYGSVSTNLQAGNAQAATADVN

SEQ ID NO: 6665 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 6666 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNDNNNSEFSWTGATTYHLNGRDSLVNPGPAMASHKDDNEKFFPQSGVLIFGKQDTGKNNVAIERVMITDEEEIRTTNPVATEQYGSVSTNLQAGNAQAATADVN

SEQ ID NO: 6667 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTSGTMTMSRLRFSQAGASDIRDQSRNWLPGPCYRQQRVSKTDGENNNSDFSWTGATKYHLNGRDSLVNPGPAMASHKDDEDKFFPQSGVLIFGKQNSARSNVEIGGVMITDEEEIRTTNPVATEQYGSVSTNLQAGNAQAATADVN

SEQ ID NO: 6668 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQPGNAQAATADVN

SEQ ID NO: 6669 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSTGTNTDIGQVMITDEEEIRTTNPVATEQYGSVSTNLQAGNAQAATADVN

SEQ ID NO: 6670 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPNQNNNSNFSWTGATTYHLNGRDSLVNPGPAMASHKDDNEKFFPQSGVLIFGKEGTDKANVDIDGVMITDEEEIRTTNPVATEQYGSVSTNLQAGNAQAATADVN

SEQ ID NO: 6671 - protein, 334 aa, Artificial Sequence
  Synthetic
STGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSTQSTHNNNSDFSWTGATKYHLNGRDSLVNPGPAMASHRDDADSFFPQSGVLIFGKQGSEKTNVDIEKVMITDEEEIRTTNPVATEQYGSVSTNLQAGNAQAATADVN

SEQ ID NO: 6672 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNAEGGLKTMSHLLFSQAGASDIRDQSRNWLPGPCYRQQRVSKTDGENNNSDFSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 6673 - protein, 334 aa, Artificial Sequence; identical to SEQ ID NO: 4266
  Synthetic

SEQ ID NO: 6674 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQDSDNNNSNFSWTGATKYHLNGRDSLVNPGPAMASHKDDDDRFFPQSGVLIFGKEGSEKTNVDIEKVMITDEEEIRTTNPVATEQYGSVSTNLQAGNAQAATADVN

SEQ ID NO: 6675 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHKDDDDRFFPQSGVLIFGKEGADGSNVEIGNVMITDEEEIRTTNPVATEQYGSVSTNLQAGNAQAATADVN

SEQ ID NO: 6676 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNGKFFPQSGVLIFGKQGSEKTNVDIEKVMITDEEEIRTTNPVATEQYGSVSTNLQRGNRQAATADVN

SEQ ID NO: 6677 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDMGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6678 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKEGTAETNIDIEKVMITDEEEIRTTNPVATEQYGSVSTNLQAGNAQAATADVN

SEQ ID NO: 6679 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKEDGKGANVDIGEVMITDEEEIRTTNPVATEQYGSVSTNLQAGNAQAATADVN

SEQ ID NO: 6680 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAGAGNKTLSRLKFSQAGASDIRDQSRNWLPGPCYRQQRVSKQASDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6681 - protein, 334 aa, Artificial Sequence; identical to SEQ ID NO: 2944
  Synthetic

SEQ ID NO: 6682 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATKYHLNGRDSLVNPGPAMASHKDDDDRFFPQSGVLIFGKEDATRSNVEIEGVMITDEEEIRTTNPVATEQYGSVSTNLQAGNAQAATADVN

SEQ ID NO: 6683 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKSGNETLSQLVFSQAGASDIRDQSRNWLPGPCYRQQRVSKQPGDNNNSNFSWTGATKYHLNGRDSLVNPGPAMASHKDDDEKFFPQSGVLIFGKEGTGATDVEYDQVMITDEEEIRTTNPVATEQYGSVSTNLQAGNAQAATADVN

SEQ ID NO: 6684 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDTDKFFPQSGVLIFGKQGSEKTNVDIEKVMITDEEEIRTTNPVATEQYGSVSTNLQAGNAQAATADVN

SEQ ID NO: 6685 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNGRTGSTTLSGLRFSQAGASDIRDQSRNWLPGPCYRQQRVSKQANHNNNSEFSWTGATTYHLNGRDSLVNPGPAMASHEDDTEKFFPQSGVLIFGKQGSEKTNVDIEKVMITDEEEIRTTNPVATEQYGSVSTNLQAGNAQAATADVN

SEQ ID NO: 6686 - protein, 334 aa, Artificial Sequence; identical to SEQ ID NO: 93
  Synthetic

SEQ ID NO: 6687 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDDKFFPQSGVLIFGKEGGGGSDVEFDGVMITDEEEIRTTNPVATEQYGSVSTNLQAGNAQAATADVN

SEQ ID NO: 6688 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHRDDDDKFFPQSGVLIFGKQGSEKTNVDIEKVMITDEEEIRTTNPVATEQYGSVSTNLQEGRSQAAFAEVH

SEQ ID NO: 6689 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQDANRNNVEIGQVMITDEEEIRTTNPVATEQYGSVSTNLQAGNAQAATADVN

SEQ ID NO: 6690 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKEGAGKTDVAIGRVMITDEEEIRTTNPVATEQYGSVSTNLQAGNAQAATADVN

SEQ ID NO: 6691 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGSGITTKSKLGFSQAGASDIRDQSRNWLPGPCYRQQRVSKQPSQNNNSNFSWTGATKYHLNGRDSLVNPGPAMASHEDDTGRFFPQSGVLIFGKEGGAGADVDIGQVMITDEEEIRTTNPVATEQYGSVSTNLQAGNAQAATADVN

SEQ ID NO: 6692 - protein, 334 aa, Artificial Sequence
  Synthetic
QAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPIGTTTQSRLQFSQAGASDIRDQSRNWLPGPCYRQQRVSKTSADNNNSEFSWTGATKYHLNGRDSLVNPGPAMASHKDDEEKFFPQSGVLIFGKENGGTNNVEIGNVMITDEEEIRTTNPVATEQYGSVSTNLQAGNAQAATADVN

SEQ ID NO: 6693 - protein, 334 aa, Artificial Sequence
  Synthetic
DAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSTTASHNNNSDFSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6694 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGQNNNSNFSWTGATKYHLNGRDSLVNPGPAMASHEDDADKFFPQSGVLIFGKQSASENNIDIDRVMITDEEEIRTTNPVATEQYGSVSTNLQAGNAQAATADVN

SEQ ID NO: 6695 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHRDDTGKFFPQSGVLIFGKQGSEKTNVDIEKVMITDEEEIRTTNPVATEQYGSVSTNLQAGNAQAATADVN

SEQ ID NO: 6696 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLGFSQAGASDIRDQSRNWLPGPCYRQQRVSKQPGDNNNSDFSWTGATKYHLNGRDSLVNPGPAMASHKDDDEKFFPQSGVLIFGKQGSEKTNVDIEKVMITDEEEIRTTNPVATEQYGSVSTNLQRGNAQAATADVN

SEQ ID NO: 6697 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6698 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEDKFFPQSGVLIFGKESGSKSNIAIDQVMITDEEEIRTTNPVATEQYGSVSTNLQAGNAQAATADVN

SEQ ID NO: 6699 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6700 - protein, 334 aa, Artificial Sequence; identical to SEQ ID NO: 2987
  Synthetic

SEQ ID NO: 6701 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDNEKFFPQSGVLIFGKQDSTGNNIDIEQVMITDEEEIRTTNPVATEQYGSVSTNLQAGNAQAATADVN

SEQ ID NO: 6702 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKESAGANNVDIGGVMITDEEEIRTTNPVATEQYGSVSTNLQAGNAQAATADVN

SEQ ID NO: 6703 - protein, 334 aa, Artificial Sequence
  Synthetic
GAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQGGNQTQSALRFSQAGASDIRDQSRNWLPGPCYRQQRVSKTSADNNNSEYSWTGATKYHLNGRDSLVNPGPAMASHEDDDDRFFPQSGVLIFGKQNAEASNADIDRVMITDEEEIRTTNPVATEQYGSVSTNLQAGNAQAATADVN

SEQ ID NO: 6704 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGAAASDAAYENVMITDEEEIRTTNPVATEQYGSVSTNLQAGNAQAATADVN

SEQ ID NO: 6705 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNAGGLLTTSHLKFSQAGASDIRDQSRNWLPGPCYRQQRVSKTSADNNNSEYSWTGATKYHLNGRDSLVNPGPAMASHGDDEGKFFPQSGVLIFGKQGSEKTNVDIEKVMITDEEEIRTTNPVATEQYGSVSTNLQRGNRQAATADVN

SEQ ID NO: 6706 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNNSGNTTMSRLGFSQAGASDIRDQSRNWLPGPCYRQQRVSKTSADNNNSEYSWTGATKYHLNGRDSLVNPGPAMASHEDDKDKFFPQSGVLIFGKQGSEKTNVDIEKVMITDEEEIRTTNPVATEQYGSVSTNLQAGNAQAATADVN

SEQ ID NO: 6707 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNDKFFPQSGVLIFGKQSAGAANIAIEQVMITDEEEIRTTNPVATEQYGSVSTNLQAGNAQAATADVN

SEQ ID NO: 6708 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGAEADNAAFEKVMITDEEEIRTTNPVATEQYGSVSTNLQAGNAQAATADVN

SEQ ID NO: 6709 - protein, 334 aa, Artificial Sequence; identical to SEQ ID NO: 326
  Synthetic

SEQ ID NO: 6710 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGNKTMSRLQFSQAGASDIRDQSRNWLPGPCYRQQRVSKQPSENNNSDFSWTGATKYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 6711 - protein, 334 aa, Artificial Sequence; identical to SEQ ID NO: 437
  Synthetic

SEQ ID NO: 6712 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDDVMITDEEEIRTTNPVATEQYGSVSTNLQRGNRRAATADVN

SEQ ID NO: 6713 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSSGNNNSDFSWTGATTYHLNGRDSLVNPGPAMASHKDDADRFFPQSGVLIFGKQSGATGNVDFDGVMITDEEEIRTTNPVATEQYGSVSTNLQAGNAQAATADVN

SEQ ID NO: 6714 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSTTASHNNNSDFSWTGATKYHLNGRDSLVNPGPAMASHKDDEEKFFPQSGVLIFGKQGASETNVEIDKVMITDEEEIRTTNPVATEQYGSVSTNLQAGNAQAATADVN

SEQ ID NO: 6715 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGSGITTPSRLRFSQAGASDIRDQSRNWLPGPCYRQQRVSKPPNDNNNSEFSWTGATTYHLNGRDSLVNPGPAMASHKDDADRFFPQSGVLIFGKENAGRSDVDFGGVMITDEEEIRTTNPVATEQYGSVSTNLQAGNAQAATADVN

SEQ ID NO: 6716 - protein, 334 aa, Artificial Sequence; identical to SEQ ID NO: 498
  Synthetic

SEQ ID NO: 6717 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKQGGNGNNVEIESVMITDEEEIRTTNPVATEQYGSVSTNLQAGNAQAATADVN

SEQ ID NO: 6718 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQDAKGNNVEVGQVMITDEEEIRTTNPVATEQYGSVSTNLQAANAQAATADVN

SEQ ID NO: 6719 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6720 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQGSEKTNVDIEKVMITDEEEIRTTNPVATEQYGSVSTNLQAGNTQAATADVN

SEQ ID NO: 6721 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPGGNNNSEYSWTGATKYHLNGRDSLVNPGPAMASHKDDDDRFFPQSGVLIFGKEGSTAANAAFDKVMITDEEEIRTTNPVATEQYGSVSTNLQAGNAQAATADVN

SEQ ID NO: 6722 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTHGDNNNSNFSWTGATTYHLNGRDSLVNPGPAMASHKDDTDRFFPQSGVLIFGKQSAEKTNAEVDDVMITDEEEIRTTNPVATEQYGSVSTNLQAGNAQAATADVN

SEQ ID NO: 6723 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKGGNTTKSGLGFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6724 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSVDNNNSDFSWTGATKYHLNGRDSLVNPGPAMASHKDDDDKFFPQSGVLIFGKQDSERTDVEIEKVMITDEEEIRTTNPVATEQYGSVSTNLQAGNAQAATADVN

SEQ ID NO: 6725 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDAGKFFPQSGVLIFGKQGSEKTNVDIEKVMITDEEEIRTTNPVATEQYGSVSTNLQAGNRQAATADVN

SEQ ID NO: 6726 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHEDDTGRFFPQSGVLIFGKQGSRKGNVDIEEVMITDEEEIRTTNPVATEQYGSVSTNLQAGNAQAATADVN

SEQ ID NO: 6727 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHRDDNDKFFPQSGVLIFGKQGAGKTNIAYGNVMITDEEEIRTTNPVATEQYGSVSTNLQAGNAQAATADVN

SEQ ID NO: 6728 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTGGPATLSTLKFSQAGASDIRDQSRNWLPGPCYRQQRVSKTDGENNNSDFSWTGATKYHLNGRDSLVNPGPAMASHKDDEEKFFPQSGVLIFGKEGAGANDVAYENVMITDEEEIRTTNPVATEQYGSVSTNLQAGNAQAATADVN

SEQ ID NO: 6729 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNNKTGITTQSRLQFSQAGASDIRDQSRNWLPGPCYRQQRVSKTSADNNNSDFSWTGATKYHLNGRDSLVNPGPAMASHKDDDERFFPQSGVLIFGKQDANRNNADVDHVMITDEEEIRTTNPVATEQYGSVSTNLQAGNAQAATADVN

SEQ ID NO: 6730 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTAGRNNNSEYSWTGATTYHLNGRDSLVNPGPAMASHEDDDEKFFPQSGVLIFGKQGSEKTNVDIEKVMITDEEEIRTTNPVATEQYGSVSTNLQAGNAQAATADVN

SEQ ID NO: 6731 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHRDDNDKFFPQSGVLIFGKQGAGKTNIAYGNVMITDEEEIRTTNPVATEQYGSVSTNLQAGNAQAATADVN

SEQ ID NO: 6732 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTDRFFPQSGVLIFGKEGAGGNNVEIDDVMITDEEEIRTTNPVATEQYGSVSTNLQAGNAQAATADVN

SEQ ID NO: 6733 - protein, 334 aa, Artificial Sequence; identical to SEQ ID NO: 2070
  Synthetic

SEQ ID NO: 6734 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDHTGTDTPSRLRFSQAGASDIRDQSRNWLPGPCYRQQRVSKTSNGNNNSEFSRTGATKYHLNGRDSLVNPGPAMASHRDDEDKFFPQSGVLIFGKEDARKDNVEVGEVMITDEEEIRTTNPVATEQYGSVSTNLQAGNAQAATADVN

SEQ ID NO: 6735 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6736 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6737 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKAGSETNSRLKFSQAGASDIRDQSRNWLPGPCYRQQRVSTTAGDNNNSNFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6738 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGNSGRMTTSRLEFSQAGASDIRDQSRNWLPGPCYRQQRVSKTHGDNNNSNFSWTGATTYHLNGRDSLVNPGPAMASHKDDAEKFFPQSGVLIFGKEGAGKTNIAIDDVMITDEEEIRTTNPVATEQYGSVSTNLQAGNAQAATADVN

SEQ ID NO: 6739 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6740 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHGDDNEKFFPQSGVLIFGKQGSEKTNVDIEKVMITDEEEIRTTNPVATEQYGSVSTNLQRGNRQAATADVN

SEQ ID NO: 6741 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDEKFFPQSGVLIFGKESAAGDNIEIGDVMITDEEEIRTTNPVATEQYGSVSTNLQAGNAQAATADVN

SEQ ID NO: 6742 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRATAAADGVQ

SEQ ID NO: 6743 - protein, 334 aa, Artificial Sequence; identical to SEQ ID NO: 555
  Synthetic

SEQ ID NO: 6744 - protein, 334 aa, Artificial Sequence
  Synthetic
GTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGSPTKSRLGFSQAGASDIRDQSRNWLPGPCYRQQRVSKQPGDNNNSNFSWTGATKYHLNGRDSLVNPGPAMASHKDDDDRFFPQSGVLIFGKQGSEKTNVDIEKVMITDEEEIRTTNPVATEQYGSVSTNLQDRRSAAAYTTVQ

SEQ ID NO: 6745 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTNAVKASFSQAGASDIRDQSRNWLPGPCYRQQRVSKTSADNNNSEYSWTGATKYHLNGRDSLVNPGPAMASHEDDNDKFFPQSGVLIFGKQGSEKTNVDIEKVMITDEEEIRTTNPVATEQYGSVSTNLQAGNAQAATADVN

SEQ ID NO: 6746 - protein, 334 aa, Artificial Sequence
  Synthetic
DAGAANDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTSADNNNSEYSWTGATKYHLNGRDSLVNPGPAMASHKDDAEKFFPQSGVLIFGKQNSKATDAEIEDVMITDEEEIRTTNPVATEQYGSVSTNLQAGNAQAATADVN

SEQ ID NO: 6747 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQRGNRQAATADVN

SEQ ID NO: 6748 - protein, 334 aa, Artificial Sequence; identical to SEQ ID NO: 2082
  Synthetic

SEQ ID NO: 6749 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSASGRATQSRLRFSQAGASDIRDQSRNWLPGPCYRQQRVSKTSDGNNNSDFSWTGATKYHLNGRDSLVNPGPAMASHRDDTDRFFPQSGVLIFGKQGAEANNVAVEQVMITDEEEIRTTNPVATEQYGSVSTNLQGAKGNAASGDVT

SEQ ID NO: 6750 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6751 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGNLTTSSLLFSQAGASDIRDQSRNWLPGPCYRQQRVSKTAADNNNSDFSWTGATKYHLNGRDSLVNPGPAMASHKDDDEKFFPQSGVLIFGKQSTREGDVDIENVMITDEEEIRTTNPVATEQYGSVSTNLQAGNAQAATADVN

SEQ ID NO: 6752 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGIMTLSELRFSQAGASDIRDQSRNWLPGPCYRQQRVSKTDGENNNSDFSWTGATKYHLNGRDSLVNPGPAMASHKDDEEKFFPQSGVLIFGKENAAANNADYESVMITDEEEIRTTNPVATEQYGSVSTNLQAGNAQAATADVN

SEQ ID NO: 6753 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGTGSMTNSGLRFSQAGASDIRDQSRNWLPGPCYRQQRVSKKDDGNNNSNFSWTGATTYHLNGRDSLVNPGPAMASHEDDAGKFFPQSGVLIFGKQGSEKTNVDIEKVMITDEEEIRTTNPVATEQYGSVSTNLQRGNRQAATADVN

SEQ ID NO: 6754 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRSGIITQSALRFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6755 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 6756 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHRDDTGKFFPQSGVLIFGKQGATAANVAVDNVMITDEEEIRTTNPVATEQYGSVSTNLQAGNAQAATADVN

SEQ ID NO: 6757 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKESTARNNADVEQVMITDEEEIRTTNPVATEQYGSVSTNLQAGNAQAATEDVN

SEQ ID NO: 6758 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTSGITTNSTLGFSQAGASDIRDQSRNWLPGPCYRQQRVSKVSADNNNSEFSWTGATKYHLNGRDSLVNPGPAMASHKDDEEKFFPQSGVLIFGKQSGSKNDIAIEDVMITDEEEIRTTNPVATEQYGSVSTNLQAGNAQAATADVN

SEQ ID NO: 6759 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKATDNNNSNFSWTGATTYHLNGRDSLVNPGPAMASHRDDAGKFFPQSGVLIFGKEGSGKDDVEYDQVMITDEEEIRTTNPVATEQYGSVSTNLQAGNAQAATADVN

SEQ ID NO: 6760 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATTGNVTTSKLSFSQAGASDIRDQSRNWLPGPCYRQQRVSKQSDRNNNSEFSWTGATKYHLNGRDSLVNPGPAMASHKDDEDKFFPQSGVLIFGKEGTGANNAEIGEVMITDEEEIRTTNPVATEQYGSVSTNLQAGNAQAATADVN

SEQ ID NO: 6761 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGNITLSKLRFSQAGASDIRDQSRNWLPGPCYRQQRVSTPPSQNNNSNFSWTGATTYHLNGRDSLVNPGPAMASHKDDDDRFFPQSGVLIFGKQGSEKTNVDIEKVMITDEEEIRTTNPVATEQYGSVSTNLQTRRDPAADNMVT

SEQ ID NO: 6762 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTATGIATPSKLMFSQAGASDIRDQSRNWLPGPCYRQQRVSKTSADNNNSNFSWTGATKYHLNGRDSLVNPGPAMASHRDDEDKFFPQSGVLIFGKQGSEKTNVDIEKVMITDEEEIRTTNPVATEQYGSVSTNLQAGNAQAATADVN

SEQ ID NO: 6763 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSERTGAADGTVT

SEQ ID NO: 6764 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQAGNAQAATADVN

SEQ ID NO: 6765 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDGAGRNTTSSLGFSQAGASDIRDQSRNWLPGPCYRQQRVSKTHGDNNNSNFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6766 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGARGEAAYNVVA

SEQ ID NO: 6767 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNMTNSTLRFSQAGASDIRDQSRNWLPGPCYRQQRVSKTDGENNNSDFSWTGATKYHLNGRDSLVNPGPAMASHKDDEEKFFPQSGVLIFGKEGTTGNDIDIERVMITDEEEIRTTNPVATEQYGSVSTNLQAGNAQAATADVN

SEQ ID NO: 6768 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDERFFPQSGVLIFGKQGASETNVEIDKVMITDEEEIRTTNPVATEQYGSVSTNLQAGNAQAATADVN

SEQ ID NO: 6769 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKQGAKGTNVAVEKVMITDEEEIRTTNPVATEQYGSVSTNLQAGNAQAATADVN

SEQ ID NO: 6770 - protein, 334 aa, Artificial Sequence; identical to SEQ ID NO: 3148
  Synthetic

SEQ ID NO: 6771 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDKSGPTTMSTLRFSQAGASDIRDQSRNWLPGPCYRQQRVSKQPNDNNNSEFSWTGATTYHLNGRDSLVNPGPAMASHKDDNEKFFPQSGVLIFGKESATGGNTDIGGVMITDEEEIRTTNPVATEQYGSVSTNLQAGNAQAATADVN

SEQ ID NO: 6772 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDGGLATKSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6773 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAGRNNNSEFSWTGATKYHLNGRDSLVNPGPAMASHKDDEGRFFPQSGVLIFGKQGSEKTNVDIEKVMITDEEEIRTTNPVATEQYGSVSTNLQAGNAQAATADVN

SEQ ID NO: 6774 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNDQSGRTTPSSLRFSQAGASDIRDQSRNWLPGPCYRQQRVSKTDGENNNSDFSWTGATKYHLNGRDSLVNPGPAMASHKDDEEKFFPQSGVLIFGKQNSARSNVEIGQVMITDEEEIRTTNPVATEQYGSVSTNLQAGNAQAATADVN

SEQ ID NO: 6775 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTEATKYHLNGRDSLVNPGPAMASHRDDAGKFFPQSGVLIFGKQGSEKTNVDIEKVMITDEEEIRTTNPVATEQYGSVSTNLQAGNAQAATADVN

SEQ ID NO: 6776 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGLQTHSRLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6777 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 6778 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSTDNNNSNFSWTGATTYHLNGRDSLVNPGPAMASHKDDDDRFFPQSGVLIFGKQSAKAANAAIDEVMITDEEEIRTTNPVATEQYGSVSTNLQAGNAQAATADVN

SEQ ID NO: 6779 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGGADNIDIERVMITDEEEIRTTNPVATEQYGSVSTNLQAGNAQAATADVN

SEQ ID NO: 6780 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGHGGNKTISNLRFSQAGASDIRDQSRNWLPGPCYRQQRVSKTPSHNNNSDFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6781 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQSTHNNNSDFSWTGATKYHLNGRDSLVNPGPAMASHKDDEDKFFPQSGVLIFGKENSGTNNAEIDNVMITDEEEIRTTNPVATEQYGSVSTNLQAGNAQAATADVN

SEQ ID NO: 6782 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHRDDAGKFFPQSGVLIFGKEGASGTNIDVGRVMITDEEEIRTTNPVATEQYGSVSTNLQAGNAQAATADVN

SEQ ID NO: 6783 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGGTAGNVDVEGVMITDEEEIRTTNPVATEQYGSVSTNLQAGNAQAATADVN

SEQ ID NO: 6784 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKEKFFPQSGVLIFGKEGAGRDDVDVEEVMITDEEEIRTTNPVATEQYGSVSTNLQAGNAQAATADVN

SEQ ID NO: 6785 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKQSSDNNNSNFSWTGATTYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6786 - protein, 334 aa, Artificial Sequence
  Synthetic
SSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 6787 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEGRFFPQSGVLIFGKEDGDGANVAIDRVMITDEEEIRTTNPVATEQYGSVSTNLQAGNAQAATADVN

SEQ ID NO: 6788 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQRGNRQAATADVN

SEQ ID NO: 6789 - protein, 334 aa, Artificial Sequence
  Synthetic
HSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTDGENNNSDFSWTGATKYHLNGRDSLVNPGPAMASHKDDEEKFFPQSGVLIFGKEGTDANDVDVGQVMITDEEEIRTTNPVATEQYGSVSTNLQAGNAQAATADVN

SEQ ID NO: 6790 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDDKFFPQSGVLIFGKQGSEKTNVDIEKVMITDEEEIRTTNPVATEQYGSVSTNLQAGNAQAATADVN

SEQ ID NO: 6791 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHEDDNDKFFPQSGVLIFGKQGSEKTNVDIEKVMITDEEEIRTTNPVATEQYGSVSTNLQRGNRQAATADVN

SEQ ID NO: 6792 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6793 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6794 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDTTGLHTKSTLGFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6795 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRGGNITKSPLHFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6796 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGNHSPAADAMVQ

SEQ ID NO: 6797 - protein, 334 aa, Artificial Sequence; identical to SEQ ID NO: 1045
  Synthetic

SEQ ID NO: 6798 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTRSRLQFSQAGASDIRDQSRNWLPGPCYRQQRVSKTDGENNNSDFSWTGATKYHLNGRDSLVNPGPAMASHKDDEEKFFPQSGVLIFGKQGAGKDDVDIGGVMITDEEEIRTTNPVATEQYGSVSTNLQAGNAQAATADVN

SEQ ID NO: 6799 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQANSNPAASDSVQ

SEQ ID NO: 6800 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHEDDNGKFFPQSGVLIFGKEGGKATNVDFDGVMITDEEEIRTTNPVATEQYGSVSTNLQAGNAQAATADVN

SEQ ID NO: 6801 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGGARTDVEIGEVMITDEEEIRTTNPVATEQYGSVSTNLQAGNAQAATADVN

SEQ ID NO: 6802 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDDGRFFPQSGVLIFGKQGSEKTNVDIEKVMITDEEEIRTTNPVATEQYGSVSTNLQRGNRQAATADVN

SEQ ID NO: 6803 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDKDKFFPQSGVLIFGKESAGANNVDIGGVMITDEEEIRTTNPVATEQYGSVSTNLQAGNAQAATADVN

SEQ ID NO: 6804 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTGGTNTMSTLQFSQAGASDIRDQSRNWLPGPCYRQQRVSKKSTGNNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6805 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSRTGTATQSTLNFSQAGASDIRDQSRNWLPGPCYRQQRVSTTPADNNNSDFSWTGATKYHLNGRDSLVNPGPAMASHKDDDEKFFPQSGVLIFGKQGSEKTNVDIEKVMITDEEEIRTTNPVATEQYGSVSTNLQRGNRQAATADVN

SEQ ID NO: 6806 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEYSWTGATKYHLNGRDSLVNPGPAMASHRDDEDKFFPQSGVLIFGKEGAGKTDVAIGRVMITDEEEIRTTNPVATEQYGSVSTNLQAGNAQAATADVN

SEQ ID NO: 6807 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQGARRNDAEFGSVMITDEEEIRTTNPVATEQYGSVSTNLQAGNAQAATADVN

SEQ ID NO: 6808 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSPTGNVTLSDLQFSQAGASDIRDQSRNWLPGPCYRQQRVSKQPSQNNNSNFSWTGATKYHLNGRDSLVNPGPAMASHKDDEEKFFPQSGVLIFGKEGASKANTAVEHVMITDEEEIRTTNPVATEQYGSVSTNLQAGNAQAATADVN

SEQ ID NO: 6809 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDEEKFFPQSGVLIFGKQGASTTNAAIEDVMITDEEEIRTTNPVATEQYGSVSTNLQAGNAQAATADVN

SEQ ID NO: 6810 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESSAKTNAAYGEVMITDEEEIRTTNPVATEQYGSVSTNLQAGNAQAATADVN

SEQ ID NO: 6811 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEESFFPQSGVLIFGKQSAEGGNVDIDGVMITDEEEIRTTNPVATEQYGSVSTNLQAGNAQAATADVN

SEQ ID NO: 6812 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQANHNNNSEFSWTGATTYHLNGRDSLVNPGPAMASHRDDDEKFFPQSGVLIFGKQSAKAANAAIDEVMITDEEEIRTTNPVATEQYGSVSTNLQAGNAQAATADVN

SEQ ID NO: 6813 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHEDDNDKFFPQSGVLIFGKEGAGGNDVDIERVMITDEEEIRTTNPVATEQYGSVSTNLQAGNAQAATADVN

SEQ ID NO: 6814 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDGKFFPQSGVLIFGKQNSGATDVAIGGVMITDEEEIRTTNPVATEQYGSVSTNLQAGNAQAATADVN

SEQ ID NO: 6815 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSSDNNNSEFSWTGATKYHLNGRDSLVNPGPAMASHKDDEDKFFPQSGVLIFGKQGSEKTNVDIEKVMITDEEEIRTTNPVATEQYGSVSTNLQRGNRQAATADVN

SEQ ID NO: 6816 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGTGNMTLSQLGFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTEHNPAAFRSVT

SEQ ID NO: 6817 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNDNNNSNFSWTGATKYHLNGRDSLVNPGPAMASHRDDEDKFFPQSGVLIFGKESTGGNDVEYDQVMITDEEEIRTTNPVATEQYGSVSTNLQAGNAQAATADVN

SEQ ID NO: 6818 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTEAGSLTKSQLRFSQAGASDIRDQSRNWLPGPCYRQQRVSKTDDGNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6819 - protein, 334 aa, Artificial Sequence
  Synthetic
TSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKQSSDNNNSEFSWTGATKYHLNGRDSLVNPGPAMASHEDDNEKFFPQSGVLIFGKQGSEKTNVDIEKVMITDEEEIRTTNPVATEQYGSVSTNLQTPRNNAATEVVD

SEQ ID NO: 6820 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDAEKFFPQSGVLIFGKQGSEKTNVDIEKVMITDEEEIRTTNPVATEQYGSVSTNLQGPRTGAATHTVE

SEQ ID NO: 6821 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKEGSGGNDVDIERVMITDEEEIRTTNPVATEQYGSVSTNLQAGNAQAATADVN

SEQ ID NO: 6822 - protein, 334 aa, Artificial Sequence; identical to SEQ ID NO: 3286
  Synthetic

SEQ ID NO: 6823 - protein, 334 aa, Artificial Sequence
  Synthetic
ETGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGSEKTNVDIEKVMITDEEEIRTTNPVATEQYGSVSTNLQAGNAQAATADVN

SEQ ID NO: 6824 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDDNNNSDFSWPGATKYHLNGRDSLVNPGPAMASHKDDAEKFFPQSGVLIFGKQGSEKTNVDIEKVMITDEEEIRTTNPVATEQYGSVSTNLQRGNRQAATADVN

SEQ ID NO: 6825 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTTGHVTKSRLIFSQAGASDIRDQSRNWLPGPCYRQQRVSKQASDNNNSEFSWTGATKYHLNGRDSLVNPGPAMASHKDDDDKFFPQSGVLIFGKENASGTNVDIGNVMITDEEEIRTTNPVATEQYGSVSTNLQAGNAQAATADVN

SEQ ID NO: 6826 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 6827 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDDDRFFPQSGVLIFGKESGGTDNVDIDRVMITDEEEIRTTNPVATEQYGSVSTNLQAGNAQAATADVN

SEQ ID NO: 6828 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDKGKFFPQSGVLIFGKQGSEKTNVDIEKVMITDEEEIRTTNPVATEQYGSVSTNLQRGNRQAATADVN

SEQ ID NO: 6829 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNETGNATPSRLKFSQAGASDIRDQSRNWLPGPCYRQQRVSKTHGDNNNSNFSWTGATTYHLNGRDSLVNPGPAMASHKDDAEKFFPQSGVLIFGKQGSEKTNVDIEKVMITDEEEIRTTNPVATEQYGSVSTNLQAGNAQAATADVN

SEQ ID NO: 6830 - protein, 334 aa, Artificial Sequence; identical to SEQ ID NO: 4221
  Synthetic

SEQ ID NO: 6831 - protein, 334 aa, Artificial Sequence
  Synthetic
TAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQSRQNTAATTNVD

SEQ ID NO: 6832 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDHSGIDTKSRLVFSQAGASDIRDQSRNWLPGPCYRQQRVSTTPGGNNNSNFSWTGATKYHLNGRDSLVNPGPAMASHKDDDGKFFPQSGVLIFGKESGGGNNIAIDQVMITDEEEIRTTNPVATEQYGSVSTNLQAGNAQAATADVN

SEQ ID NO: 6833 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRSSGAASNAVD

SEQ ID NO: 6834 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKTDGENNNSDFSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6835 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEESFFPQSGVLIFGKQGSEKTNVDIEKVMITDEEEIRTTNPVATEQYGSVSTNLQRGNRQAATADVN

SEQ ID NO: 6836 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTHGDNNNSNFSWTGATTYHLNGRDSLVNPGPAMASHKDDAEKFFPQSGVLIFGKQGAGKSDVEVGKVMITDEEEIRTTNPVATEQYGSVSTNLQAGNAQAATADVN

SEQ ID NO: 6837 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTSADNNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6838 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNSGSGIKTKSDLRFSQAGASDIRDQSRNWLPGPCYRQQRVSKKPDQNNNSDFSWTGATKYHLNGRDSLVNPGPAMASHKDDDEKFFPQSGVLIFGKQNATGTNVDVGSVMITDEEEIRTTNPVATEQYGSVSTNLQAGNAQAATADVN

SEQ ID NO: 6839 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDERKFFPQSGVLIFGKEGADGANVAYDRVMITDEEEIRTTNPVATEQYGSVSTNLQAGNAQAATADVN

SEQ ID NO: 6840 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSLTMSRLIFSQAGASDIRDQSRNWLPGPCYRQQRVSKTSADNNNSEYSWTGATKYHLNGRDSLVNPGPAMASHKDDNDRFFPQSGVLIFGKQGSEKTNVDIEKVMITDEEEIRTTNPVATEQYGSVSTNLQAGNAQAATADVN

SEQ ID NO: 6841 - protein, 334 aa, Artificial Sequence; identical to SEQ ID NO: 609
  Synthetic

SEQ ID NO: 6842 - protein, 334 aa, Artificial Sequence
  Synthetic
AAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSSGNKTMSALRFSQAGASDIRDQSRNWLPGPCYRQQRVSKTAGRNNNSDFSWTGATTYHLNGRDSLVNPGPAMASHRDDDEKFFPQSGVLIFGKQGSEKTNVDIEKVMITDEEEIRTTNPVATEQYGSVSTNLQAGNAQAATADVN

SEQ ID NO: 6843 - protein, 334 aa, Artificial Sequence; identical to SEQ ID NO: 2046
  Synthetic

SEQ ID NO: 6844 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKENASGGNAEIDSVMITDEEEIRTTNPVATEQYGSVSTNLQRGNRQAATADVN

SEQ ID NO: 6845 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQDSETDNVDIGDVMITDEEEIRTTNPVATEQYGSVSTNLQAGNAQAATADVN

SEQ ID NO: 6846 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVN

SEQ ID NO: 6847 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEDKFFPQSGVLIFGKQGSEKTNVDIEKVMITDEEEIRTTNPVATEQYGSVSTNLQAGNAQAATADVN

SEQ ID NO: 6848 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTAGDNNNSEFSWTGATTYHLNGRDSLVNPGPAMASHKDDDDKFFPQSGVLIFGKQGTKRDDVAIDEVMITDEEEIRTTNPVATEQYGSVSTNLQAGNAQAATADVN

SEQ ID NO: 6849 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGKGGNDTTSNLGFSQAGASDIRDQSRNWLPGPCYRQQRVSKTATRNNNSDFSWTGATKYHLNGRDSLVNPGPAMASHEDDNEKFFPQSGVLIFGKQGSEKTNVDIEKVMITDEEEIRTTNPVATEQYGSVSTNLQAGNAQAATADVN

SEQ ID NO: 6850 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKPPNGNNNSEFSWTGATTYHLNGRDSLVNPGPAMASHKDDDDRFFPQSGVLIFGKEGTRKNNVDIEQVMITDEEEIRTTNPVATEQYGSVSTNLQAGNAQAATADVN

SEQ ID NO: 6851 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSTAGTQTHSQLLFSQAGASDIRDQSRNWLPGPCYRQQRVSKTDGENNNSEYSWTGATTYHLNGRDSLVNPGPAMASHKDDAGRFFPQSGVLIFGKQGSEKTNVDIEKVMITDEEEIRTTNPVATEQYGSVSTNLQAGNAQAATADVN

SEQ ID NO: 6852 - protein, 334 aa, Artificial Sequence
  Synthetic
ETGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTQTGTMTTSRLRFSQAGASDIRDQSRNWLPGPCYRQQRVSKKDTDNNNSEFSWTGATTYHLNGRDSLVNPGPAMASHKDDDDKFFPQSGVLIFGKEGSEKNDVEFEQVMITDEEEIRTTNPVATEQYGSVSTNLQAGNAQAATAEVN

SEQ ID NO: 6853 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEDKFFPQSGVLIFGKEGTGRANVAIEGVMITDEEEIRTTNPVATEQYGSVSTNLQAGNAQAATADVN

SEQ ID NO: 6854 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHEDDNGKFFPQSGVLIFGKQGANRTDVDIDRVMITDEEEIRTTNPVATEQYGSVSTNLQAGNAQAATADVN

SEQ ID NO: 6855 - protein, 334 aa, Artificial Sequence; identical to SEQ ID NO: 1567
  Synthetic

SEQ ID NO: 6856 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKSTDNNNSDFSWTGATKYHLNGRDSLVNPGPAMASHEDDNDKFFPQSGVLIFGKQGSTGTNTDIGQVMITDEEEIRTTNPVATEQYGSVSTNLQAGNAQAATADVN

SEQ ID NO: 6857 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDTRADNVEFEDVMITDEEEIRTTNPVATEQYGSVSTNLQAGNAQAATADVN

SEQ ID NO: 6858 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTSADNNNSEYSWTGATKYHLNGRDSLVNPGPAMASHGDDNEKFFPQSGVLIFGKQGSEKTNVDIEKVMITDEEEIRTTNPVATEQYGSVSTNLQAGNAQAATADVN

SEQ ID NO: 6859 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTTGGTQTTSTLGFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6860 - protein, 334 aa, Artificial Sequence
  Synthetic
ATGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQPGDNNNSDFSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6861 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGAAGADTAIDDVMITDEEEIRTTNPVATEQYGSVSTNLQAGNAQAATADVN

SEQ ID NO: 6862 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHEDDEEKFFPQSGVLIFGKQGSEKTNVDIEKVMITDEEEIRTTNPVATEQYGSVSTNLQSHRAQAAATVVH

SEQ ID NO: 6863 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPHNNAAADAVT

SEQ ID NO: 6864 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTNRDAAAANTVT

SEQ ID NO: 6865 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSNFSWTGATKYHLNGRDSLVNPGPAMASHKDDTDKFFPQSGVLIFGKQGSEKTNVDIEKVMITDEEEIRTTNPVATEQYGSVSTNLQAGNAQAATADVN

SEQ ID NO: 6866 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRTQAADRAVN

SEQ ID NO: 6867 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNGGGNNTKSTLQFSQAGASDIRDQSRNWLPGPCYRQQRVSKTSADNNNSEYSWTGATKYHLNGRDSLVNPGPAMASHRDDDDKFFPQSGVLIFGKEGARANNIEVDQVMITDEEEIRTTNPVATEQYGSVSTNLQRGNRQAATADVN

SEQ ID NO: 6868 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNNEYSWTGATKYHLNGRDSLVNPGPAMASHKDDDERFFPQSGVLIFGKQGSGGGDAAIEGVMITDEEEIRTTNPVATEQYGSVSTNLQAGNAQAATADVN

SEQ ID NO: 6869 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 6870 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGNHTQSHLRFSQAGASDIRDQSRNWLPGPCYRQQRVSKTDGENNNSDFSWTGATKYHLNGRDSLVNPGPAMASHKDDEEKFFPQSGVLIFGKESAAASDVDVGQVMITDEEEIRTTNPVATEQYGSVSTNLQAGNAQAATADVN

SEQ ID NO: 6871 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGRRDNAAYRTVT

SEQ ID NO: 6872 - protein, 334 aa, Artificial Sequence
  Synthetic
RAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDKDKFFPQSGVLIFGKQGSEKTNVDIEKVMITDEEEIRTTNPVATEQYGSVSTNLQAGNAQAATADVN

SEQ ID NO: 6873 - protein, 334 aa, Artificial Sequence; identical to SEQ ID NO: 3415
  Synthetic

SEQ ID NO: 6874 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQGSEKTNVDIEKVMITDEEEIRTTNPVATEQYGSVSTNLQRGNRQAATADVD

SEQ ID NO: 6875 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGTRSTAAFREVT

SEQ ID NO: 6876 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSEFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6877 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6878 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKDRNGAATGKVD

SEQ ID NO: 6879 - protein, 334 aa, Artificial Sequence
  Synthetic
SAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6880 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATKYHLNGRDSLVNPGPAMASHKDDDDRFFPQSGVLIFGKQNGEKANIDIEGVMITDEEEIRTTNPVATEQYGSVSTNLQAGNAQAATADVN

SEQ ID NO: 6881 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQTTSGPAATQKVN

SEQ ID NO: 6882 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6883 - protein, 334 aa, Artificial Sequence
  Synthetic
DTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKTSADNNNSEYSWTGATKYHLNGRDSLVNPGPAMASHKDDEEKFFPQSGVLIFGKEDAGKADVEIGKVMITDEEEIRTTNPVATEQYGSVSTNLQAGNAQAATADVN

SEQ ID NO: 6884 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTPNGNNNSDFSWTGATKYHLNGRDSLVNPGPAMASHGDDNDRFFPQSGVLIFGKQGSEKTNVDIEKVMITDEEEIRTTNPVATEQYGSVSTNLQAGNAQAATADVN

SEQ ID NO: 6885 - protein, 334 aa, Artificial Sequence; identical to SEQ ID NO: 4484
  Synthetic

SEQ ID NO: 6886 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAASGIQTTSKLRFSQAGASDIRDQSRNWLPGPCYRQQRVSKQASDNNNSEFSWTGATKYHLNGRDSLVNPGPAMASHKDDEEKFFPQSGVLIFGKEGAARSDVDIGSVMITDEEEIRTTNPVATEQYGSVSTNLQAGNAQAATADVN

SEQ ID NO: 6887 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGAGTVTTSGLGFSQAGASDIRDQSRNWLPGPCYRQQRVSKQPNDNNNSEFSWTGATTYHLNGRDSLVNPGPAMASHKDDNEKFFPQSGVLIFGKQDSGRADVAFESVMITDEEEIRTTNPVATEQYGSVSTNLQAGNAQAATADVN

SEQ ID NO: 6888 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNATGGNVTTSGLRFSQAGASDIRDQSRNWLPGPCYRQQRVSKKDSRNNNSDFSWTGATKYHLNGRDSLVNPGPAMASHRDDEDKFFPQSGVLIFGKQDAGKSNADIDRVMITDEEEIRTTNPVATEQYGSVSTNLQAGNAQAATADVN

SEQ ID NO: 6889 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQNEKDGAATRGVQ

SEQ ID NO: 6890 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATTYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 6891 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNASAGSTTTSTLGFSQAGASDIRDQSRNWLPGPCYRQQRVSKQSDHNNNSNFSWTGATKYHLNGRDSLVNPGPAMASHKDDDDKFFPQSGVLIFGKQGSEKTNVDIEKVMITDEEEIRTTNPVATEQYGSVSTNLQAGNAQAATADVN

SEQ ID NO: 6892 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEGTGRANVAIEGVMITDEEEIRTTNPVATEQYGSVSTNLQAGNAQAATADVN

SEQ ID NO: 6893 - protein, 334 aa, Artificial Sequence; identical to SEQ ID NO: 718
  Synthetic

SEQ ID NO: 6894 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNDGGNHTLSALRFSQAGASDIRDQSRNWLPGPCYRQQRVSTKPSDNNNSDFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6895 - protein, 334 aa, Artificial Sequence
  Synthetic
ASGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQASGNNNSNFSWTGATKYHLNGRDSLVNPGPAMASHKDDEDKFFPQSGVLIFGKEGASKTNIEYGQVMITDEEEIRTTNPVATEQYGSVSTNLQAGNAQAATADVN

SEQ ID NO: 6896 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6897 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGSNARAASDVVE

SEQ ID NO: 6898 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6899 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDSRTPAATDDVE

SEQ ID NO: 6900 - protein, 334 aa, Artificial Sequence; identical to SEQ ID NO: 641
  Synthetic

SEQ ID NO: 6901 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQYGQNNNSDFSWTGATTYHLNGRDSLVNPGPAMASHEDDTGRFFPQSGVLIFGKQGSRKGNVDIEEVMITDEEEIRTTNPVATEQYGSVSTNLQAGNAQAATADVN

SEQ ID NO: 6902 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDDGGLATKSRLRFSQAGASDIRDQSRNWLPGPCYRQQRVSKTSADNNNSEYSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6903 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6904 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTPHGSAAFTMVN

SEQ ID NO: 6905 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQGGTVTLSNLRFSQAGASDIRDQSRNWLPGPCYRQQRVSKTAADNNNSDFSWTGATKYHLNGRDSLVNPGPAMASHKDDDGKFFPQSGVLIFGKEDAGGSNAEYDKVMITDEEEIRTTNPVATEQYGSVSTNLQAGNAQAATADVN

SEQ ID NO: 6906 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSDFSWTGATTYHLNGRDSLVNPGPAMASHKDDEEKFFPQSGVLIFGKEGSGKANVDIDRVMITDEEEIRTTNPVATEQYGSVSTNLQAGNAQAATADVN

SEQ ID NO: 6907 - protein, 334 aa, Artificial Sequence; identical to SEQ ID NO: 2934
  Synthetic

SEQ ID NO: 6908 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDEKFFPQSGVLIFGKQDGAKTNVDVGRVMITDEEEIRTTNPVATEQYGSVSTNLQAGNAQAATADVN

SEQ ID NO: 6909 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6910 - protein, 334 aa, Artificial Sequence; identical to SEQ ID NO: 1217
  Synthetic

SEQ ID NO: 6911 - protein, 334 aa, Artificial Sequence; identical to SEQ ID NO: 2339
  Synthetic

SEQ ID NO: 6912 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKEGTGANNAEIGEVMITDEEEIRTTNPVATEQYGSVSTNLQAGNAQAATADVN

SEQ ID NO: 6913 - protein, 334 aa, Artificial Sequence
  Synthetic
AAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAATGNTTPSPLRFSQAGASDIRDQSRNWLPGPCYRQQRVSKTSADNNNSEYSWTGATTYHLNGRDSLVNPGPAMASHKDDDDRFFPQSGVLIFGKQGSEKTNVDIEKVMITDEEEIRTTNPVATEQYGSVSTNLQRGNRQAATADVN

SEQ ID NO: 6914 - protein, 334 aa, Artificial Sequence; identical to SEQ ID NO: 3522
  Synthetic

SEQ ID NO: 6915 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDDERFFPQSGVLIFGKQGARTADTEIDSVMITDEEEIRTTNPVATEQYGSVSTNLQAGNAQAATVDVN

SEQ ID NO: 6916 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTSSENNNSNFSWTGATKYHLNGRDSLVNPGPAMASHKDDDERFFPQSGVLIFGKEGGRGANVAVEEVMITDEEEIRTTNPVATEQYGSVSTNLQAGNAQAATADVN

SEQ ID NO: 6917 - protein, 334 aa, Artificial Sequence
  Synthetic
NSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNAEGGLKTMSHLLFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6918 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTTSTLRFSQAGASDIRDQSRNWLPGPCYRQQRVSKTYNDNNNSEFSWTGATTYHLNGRDSLVNPGPAMASHKDDDERFFPQSGVLIFGKEGATATNVEIDDVMITDEEEIRTTNPVATEQYGSVSTNLQAGNAQAATADVN

SEQ ID NO: 6919 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGQSGRVTTSRLLFSQAGASDIRDQSRNWLPGPCYRQQRVSKTAADNNNSDFSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6920 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSDTKSKLQFSQAGASDIRDQSRNWLPGPCYRQQRVSKTDNHNNNSDFSWTGATKYHLNGRDSLVNPGPAMASHKDDADRFFPQSGVLIFGKQGSEKTNVDIEKVMITDEEEIRTTNPVATEQYGSVSTNLQAGNAQAATADVN

SEQ ID NO: 6921 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDDDKFFPQSGVLIFGKESSAKTNAAYGEVMITDEEEIRTTNPVATEQYGSVSTNLQAGNAQAPTADVN

SEQ ID NO: 6922 - protein, 334 aa, Artificial Sequence
  Synthetic
HTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTKTGNVTKSTLHFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6923 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKQDSEKTNVDIEKVMITDEEEIRTTNPVATEQYGSVSTNLQAGNAQAATADVN

SEQ ID NO: 6924 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDTERFFPQSGVLIFGKQGSEKTNVDIEKVMITDEEEIRTTNPVATEQYGSVSTNLQAGNAQAATADVN

SEQ ID NO: 6925 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTKSNENNNSNFSWTGATKYHLNGRDSLVNPGPAMASHKDDDDRFFPQSGVLIFGKQGSEKTNVDIEKVMITDEEEIRTTNPVATEQYGSVSTNLQAGNTQAATADVN

SEQ ID NO: 6926 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDAEKFFPQSGVLIFGKEGATRANIEIDDVMITDEEEIRTTNPVATEQYGSVSTNLQAGNAQAATADVN

SEQ ID NO: 6927 - protein, 334 aa, Artificial Sequence
  Synthetic
TTGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSRTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6928 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGKFFPQSGVLIFGKQGTGKDNVAIGGVMITDEEEIRTTNPVATEQYGSVSTNLQAGNAQAATADVN

SEQ ID NO: 6929 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKEDGRGDNTEVDQVMITDEEEIRTTNPVATEQYGSVSTNLQAGNAQAATADVN

SEQ ID NO: 6930 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDDDRFFPQSGVLIFGKQGSEKTNVDIEKVMITDEEEIRTTNPVATEQYGSVSTNLQAGNRQAATADVN

SEQ ID NO: 6931 - protein, 334 aa, Artificial Sequence
  Synthetic
SAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQGPRTPAAFDIVA

SEQ ID NO: 6932 - protein, 334 aa, Artificial Sequence
  Synthetic
GTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGSAGRPTNSHLKFSQAGASDIRDQSRNWLPGPCYRQQRVSKTDGENNNSDFSWTGATKYHLNGRDSLVNPGPAMASHKDDEGRFFPQSGVLIFGKENAGASDIAIDHVMITDEEEIRTTNPVATEQYGSVSTNLQRGNRQAATADVN

SEQ ID NO: 6933 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQKRQAGAATHEVA

SEQ ID NO: 6934 - protein, 334 aa, Artificial Sequence
  Synthetic
TTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDRGGSTTTSALSFSQAGASDIRDQSRNWLPGPCYRQQRVSKTDGENNNSDFSWTGATKYHLNGRDSLVNPGPAMASHKDDEEKFFPQSGVLIFGKQGSEKTNVDIEKVMITDEEEIRTTNPVATEQYGSVSTNLQRGNRQAATADVN

SEQ ID NO: 6935 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDASGIATLSKLRFSQAGASDIRDQSRNWLPGPCYRQQRVSKKDSRNNNSEYSWTGATKYHLNGRDSLVNPGPAMASHRDDAGKFFPQSGVLIFGKESAGKTNVAIGEVMITDEEEIRTTNPVATEQYGSVSTNLQAGNAQAATADVN

SEQ ID NO: 6936 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDADKFFPQSGVLIFGKESAGKDDVAIDQVMITDEEEIRTTNPVATEQYGSVSTNLQAGNAQAATADVN

SEQ ID NO: 6937 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTNGGPLTKSRLLFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQAGNAQAATADVN

SEQ ID NO: 6938 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKQSARGTNADIDEVMITDEEEIRTTNPVATEQYGSVSTNLQAGNAQAATADVN

SEQ ID NO: 6939 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEGRFFPQSGVLIFGKQGAGKNNAAIGQVMITDEEEIRTTNPVATEQYGSVSTNLQAGNAQAATADVN

SEQ ID NO: 6940 - protein, 334 aa, Artificial Sequence
  Synthetic
ESGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEYSWTGATKYHLNGRDSLVNPGPAMASHKDDEDKFFPQSGVLIFGKQSASKNNIAIEDVMITDEEEIRTTNPVATEQYGSVSTNLQAGNAQAATADVN

SEQ ID NO: 6941 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQDRNSGAAYADVH

SEQ ID NO: 6942 - protein, 334 aa, Artificial Sequence
  Synthetic
NAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNKTGIVTTSELRFSQAGASDIRDQSRNWLPGPCYRQQRVSTPPGDNNNSDFSWTGATKYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6943 - protein, 334 aa, Artificial Sequence
  Synthetic
DSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSNSGPLTKSTLQFSQAGASDIRDQSRNWLPGPCYRQQRVSKTHGDNNNSNFSWTGATTYHLNGRDSLVNPGPAMASHKDDDDKFFPQSGVLIFGKESAGRSNVDVDRVMITDEEEIRTTNPVATEQYGSVSTNLQAGNAQAATADVN

SEQ ID NO: 6944 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSKAGSTTLSELRFSQAGASDIRDQSRNWLPGPCYRQQRVSKQPGDNNNSNFSWTGATKYHLNGRDSLVNPGPAMASHGDDAGKFFPQSGVLIFGKQGSEKTNVDIEKVMITDEEEIRTTNPVATEQYGSVSTNLQAGNAQAATADVN

SEQ ID NO: 6945 - protein, 334 aa, Artificial Sequence; identical to SEQ ID NO: 2394
  Synthetic

SEQ ID NO: 6946 - protein, 334 aa, Artificial Sequence
  Synthetic
TAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQPGDNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6947 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKTSADNNNSEFSWTGATKYHLNGRDSLVNPGPAMASHEDDTDKFFPQSGVLIFGKQGSEKTNVDIEKVMITDEEEIRTTNPVATEQYGSVSTNLQRGNRQAATADVN

SEQ ID NO: 6948 - protein, 334 aa, Artificial Sequence
  Synthetic
QSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKKYTDNNNSNFSWTGATTYHLNGRDSLVNPGPAMASHKDDDDRFFPQSGVLIFGKQGSEKTNVDIEKVMITDEEEIRTTNPVATEQYGSVSTNLQAGNAQAATADVN

SEQ ID NO: 6949 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNQAGSVTQSALRFSQAGASDIRDQSRNWLPGPCYRQQRVSKTSADNNNSNFSWTGATTYHLNGRDSLVNPGPAMASHKDDDDRFFPQSGVLIFGKEGSGKSDAAIGDVMITDEEEIRTTNPVATEQYGSVSTNLQAGNAQAATADVN

SEQ ID NO: 6950 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGGGGTTTKSGLRFSQAGASDIRDQSRNWLPGPCYRQQRVSKKDTDNNNSEFSWTGATTYHLNGRDSLVNPGPAMASHKDDDDKFFPQSGVLIFGKENGTKADVAFDHVMITDEEEIRTTNPVATEQYGSVSTNLQAGNAQAATADVN

SEQ ID NO: 6951 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHGDDADKFFPQSGVLIFGKQGSEKTNVDIEKVMITDEEEIRTTNPVATEQYGSVSTNLQAGNAQAATADVN

SEQ ID NO: 6952 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHEDDEERFFPQSGVLIFGKQGSEKTNVDIEKVMITDEEEIRTTNPVATEQYGSVSTNLQAGNAQAATADVN

SEQ ID NO: 6953 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEFSWTGATKYHLNGRDSLVNPGPAMASHKDDEEKFFPQSGVLIFGKQGSEKTNVDIEKVMITDEEEIRTTNPVATEQYGSVSTNLQTHRDAAATEGVE

SEQ ID NO: 6954 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLKFSQAGASDIRDQSRNWLPGPCYRQQRVSKTYNDNNNSEFSWTGATTYHLNGRDSLVNPGPAMASHKDDDERFFPQSGVLIFGKQNGRKGNVAIEEVMITDEEEIRTTNPVATEQYGSVSTNLQAGNAQAATADVN

SEQ ID NO: 6955 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTPSGTTTQSRLQFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTRKNPAAVSDVE

SEQ ID NO: 6956 - protein, 334 aa, Artificial Sequence; identical to SEQ ID NO: 302
  Synthetic

SEQ ID NO: 6957 - protein, 334 aa, Artificial Sequence
  Synthetic
TSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHGDDDGKFFPQSGVLIFGKQGSEKTNVDIEKVMITDEEEIRTTNPVATEQYGSVSTNLQRGNRQAATADVN

SEQ ID NO: 6958 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDPSGTVTTSELRFSQAGASDIRDQSRNWLPGPCYRQQRVSKTSADNNNSEYSWTGATKYHLNGRDSLVNPGPAMASHKDDDDKFFPQSGVLIFGKQGSEKTNVDIEKVMITDEEEIRTTNPVATEQYGSVSTNLQRGNRQAATADVN

SEQ ID NO: 6959 - protein, 334 aa, Artificial Sequence
  Synthetic
RAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDNDRFFPQSGVLIFGKEGAEADNAAFEKVMITDEEEIRTTNPVATEQYGSVSTNLQAGNAQAATADVN

SEQ ID NO: 6960 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHGDDDERFFPQSGVLIFGKQGSEKTNVDIEKVMITDEEEIRTTNPVATEQYGSVSTNLQAGNAQAATADVN

SEQ ID NO: 6961 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDDNNNSDFSWPGATKYHLNGRDSLVNPGPAMASHKDDAEKFFPQSGVLIFGKQGSEKTNVDIEKVMITDEEEIRTTNPVATEQYGSVSTNLQRGNRQAATADVN

SEQ ID NO: 6962 - protein, 334 aa, Artificial Sequence
  Synthetic
ASGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKKYTDNNNSNFSWTGATKYHLNGRDSLVNPGPAMASHRDDEDKFFPQSGVLIFGKEDSGGNDVEVEDVMITDEEEIRTTNPVATEQYGSVSTNLQAGNAQAATADVN

SEQ ID NO: 6963 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDKFFPQSGVLIFGKENSSAGDVDIEKVMITDEEEIRTTNPVATEQYGSVSTNLQAGNAQAATADVN

SEQ ID NO: 6964 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSDRNNNSNFSWTGATKYHLNGRDSLVNPGPAMASHGDDEDKFFPQSGVLIFGKQSGSKNNVAVEDVMITDEEEIRTTNPVATEQYGSVSTNLQAGNAQAATADVN

SEQ ID NO: 6965 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTSSGSATISKLKFSQAGASDIRDQSRNWLPGPCYRQQRVSKQHNHNNNSDFSWTGATKYHLNGRDSLVNPGPAMASHKDDDDKFFPQSGVLIFGKQNAGASDADFDQVMITDEEEIRTTNPVATEQYGSVSTNLQAGNAQAATADVN

SEQ ID NO: 6966 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDDDEFFPQSGVLIFGKQGSEKTNVDIEKVMITDEEEIRTTNPVATEQYGSVSTNLQRGNRQAATADVN

SEQ ID NO: 6967 - protein, 334 aa, Artificial Sequence
  Synthetic
GSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTQPARNNNSNFSWTGATTYHLNGRDSLVNPGPAMASHKDDDEKFFPQSGVLIFGKQGSEKTNVDIEKVMITDEEEIRTTNPVATEQYGSVSTNLQAGNAQAATADVN

SEQ ID NO: 6968 - protein, 334 aa, Artificial Sequence; identical to SEQ ID NO: 1646
  Synthetic

SEQ ID NO: 6969 - protein, 334 aa, Artificial Sequence
  Synthetic
QAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATTYHLNGRDSLVNPGPAMASHKDDEDKFFPQSGVLIFGKEGTGRANVAIEGVMITDEEEIRTTNPVATEQYGSVSTNLQAGNAQAATADVN

SEQ ID NO: 6970 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTAADNNNSDFSWTGATKYHLNGRDSLVNPGPAMASHKDDDGKFFPQSGVLIFGKENSGKANVDIEQVMITDEEEIRTTNPVATEQYGSVSTNLQAGNAQAATADVN

SEQ ID NO: 6971 - protein, 334 aa, Artificial Sequence
  Synthetic
EAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNDAAGIKTTSQLNFSQAGASDIRDQSRNWLPGPCYRQQRVSKVSADNNNSEFSWTGATKYHLNGRDSLVNPGPAMASHKDDEEKFFPQSGVLIFGKQGSEKTNVDIEKVMITDEEEIRTTNPVATEQYGSVSTNLQTTNDQAADGVVA

SEQ ID NO: 6972 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRTMTTSFFPQSGVLIFGKQGSEKTNVDIEKVMITDEEEIRTTNPVATEQYGSVSTNLQRGNRQAATADVN

SEQ ID NO: 6973 - protein, 334 aa, Artificial Sequence
  Synthetic
NAGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHKDDEEKFFPQSGVLIFGKESGGADNIDIERVMITDEEEIRTTNPVATEQYGSVSTNLQAGNAQAATADVN

SEQ ID NO: 6974 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGRTGSTTLSGLRFSQAGASDIRDQSRNWLPGPCYRQQRVSKVSADNNNSEFSWTGATKYHLNGRDSLVNPGPAMASHKDDEEKFFPQSGVLIFGKESSAATNIDIEKVMITDEEEIRTTNPVATEQYGSVSTNLQAGNAQAATADVN

SEQ ID NO: 6975 - protein, 334 aa, Artificial Sequence
  Synthetic
GSGATNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNGTGGTPTTSDLRFSQAGASDIRDQSRNWLPGPCYRQQRVSKTAGQNNNSNFSWTGATKYHLNGRDSLVNPGPAMASHKDDDDKFFPQSGVLIFGKEGAGTNDIDIERVMITDEEEIRTTNPVATEQYGSVSTNLQAGNAQAATADVN

SEQ ID NO: 6976 - protein, 334 aa, Artificial Sequence
  Synthetic
GAGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATTYHLNGRDSLVNPGPAMASHKDDNEKFFPQSGVLIFGKQGSEKTNVDIEKVMITDEEEIRTTNPVATEQYGSVSTNLQAGNAQAATADVN

SEQ ID NO: 6977 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSTTPTGNNNSDFSWTGATKYHLNGRDSLVNPGPAMASHKDDDDRFFPQSGVLIFGKQDAGKANIDIDGVMITDEEEIRTTNPVATEQYGSVSTNLQAGNAQAATADVN

SEQ ID NO: 6978 - protein, 334 aa, Artificial Sequence
  Synthetic
DSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNNTGGLHTTSRLRFSQAGASDIRDQSRNWLPGPCYRQQRVSKTSADNNNSEYSWTGATKYHLNGRDSLVNPGPAMASHKDDDGKFFPQSGVLIFGKQGSEKTNVDIEKVMITDEEEIRTTNPVATEQYGSVSTNLQAGNAQAATADVN

SEQ ID NO: 6979 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTSADNNNSEYSWTGATKYHLNGRDSLVNPGPAMASHRDDEDKFFPQSGVLIFGKEGAGRNNTDIDDVMITDEEEIRTTNPVATEQYGSVSTNLQAGNAQAATADVN

SEQ ID NO: 6980 - protein, 334 aa, Artificial Sequence
  Synthetic
NTGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNTGAGNMTTSALRFSQAGASDIRDQSRNWLPGPCYRQQRVSKKDSRNNNSDFSWTGATTYHLNGRDSLVNPGPAMASHRDDDEKFFPQSGVLIFGKQGAEATDVAFDSVMITDEEEIRTTNPVATEQYGSVSTNLQAGNAQAATADVN

SEQ ID NO: 6981 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKQSGDNNNSEFSWPGATKYHLNGRDSLVNPGPAMASHKDDEEKFFPQSGVLIFGKESSGEGNVDVDSVMITDEEEIRTTNPVATEQYGSVSTNLQRGNRQAATADVN

SEQ ID NO: 6982 - protein, 334 aa, Artificial Sequence; identical to SEQ ID NO: 878
  Synthetic

SEQ ID NO: 6983 - protein, 334 aa, Artificial Sequence; identical to SEQ ID NO: 31
  Synthetic

SEQ ID NO: 6984 - protein, 334 aa, Artificial Sequence; identical to SEQ ID NO: 3692
  Synthetic

SEQ ID NO: 6985 - protein, 334 aa, Artificial Sequence
  Synthetic
STGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYYLSRTNTPSGTTTQSRLQFSQAGASDIRDQSRNWLPGPCYRQQRVSKTDGENNNSDFSWTGATKYHLNGRDSLVNPGPAMASHRDDEDKFFPQSGVLIFGKQGSEKTNVDIEKVMITDEEEIRTTNPVATEQYGSVSTNLQRGNRQAATADVN

SEQ ID NO: 6986 - protein, 334 aa, Artificial Sequence
  Synthetic
QSGASNDNHYFGYSTPWGYFDFNRFHCHFSPRDWQRLINNNWGFRPKRLNFKLFNIQVKEVTQNDGTTTIANNLTSTVQVFTDSEYQLPYVLGSAHQGCLPPFPADVFMVPQYGYLTLNNGSQAVGRSSFYCLEYFPSQMLRTGNNFTFSYTFEDVPFHSSYAHSQSLDRLMNPLIDQYLYFLSRTNSGTGNMTKSTLEFSQAGASDIRDQSRNWLPGPCYRQQRVSKQSGQNNNSDFSWTGATKYHLNGRDSLVNPGPAMASHKDDEGKFFPQSGVLIFGKQGSEKTNVDIEKVMITDEEEIRTTNPVATEQYGSVSTNLQAGNAQAATADVN

SEQ ID NO: 6987 - protein, 334 aa, Artificial Sequence; identical to SEQ ID NO: 124
  Synthetic

SEQ ID NO: 6988 - protein, 334 aa, Artificial Sequence; identical to SEQ ID NO: 232
  Synthetic

SEQ ID NO: 6989 - protein, 334 aa, Artificial Sequence; identical to SEQ ID NO: 206
  Synthetic

SEQ ID NO: 6990 - protein, 334 aa, Artificial Sequence; identical to SEQ ID NO: 73
  Synthetic

SEQ ID NO: 6991 - protein, 334 aa, Artificial Sequence; identical to SEQ ID NO: 39
  Synthetic

SEQ ID NO: 6992 - protein, 334 aa, Artificial Sequence; identical to SEQ ID NO: 86
  Synthetic

SEQ ID NO: 6993 - protein, 334 aa, Artificial Sequence; identical to SEQ ID NO: 219
  Synthetic

SEQ ID NO: 6994 - protein, 334 aa, Artificial Sequence; identical to SEQ ID NO: 96
  Synthetic

SEQ ID NO: 6995 - protein, 334 aa, Artificial Sequence; identical to SEQ ID NO: 30
  Synthetic

SEQ ID NO: 6996 - protein, 334 aa, Artificial Sequence; identical to SEQ ID NO: 94
  Synthetic

SEQ ID NO: 6997 - protein, 334 aa, Artificial Sequence; identical to SEQ ID NO: 125
  Synthetic

SEQ ID NO: 6998 - protein, 334 aa, Artificial Sequence; identical to SEQ ID NO: 237
  Synthetic

SEQ ID NO: 6999 - protein, 334 aa, Artificial Sequence; identical to SEQ ID NO: 105
  Synthetic

SEQ ID NO: 7000 - protein, 334 aa, Artificial Sequence; identical to SEQ ID NO: 163
  Synthetic

SEQ ID NO: 7001 - protein, 334 aa, Artificial Sequence; identical to SEQ ID NO: 115
  Synthetic

SEQ ID NO: 7002 - protein, 334 aa, Artificial Sequence; identical to SEQ ID NO: 75
  Synthetic

SEQ ID NO: 7003 - protein, 334 aa, Artificial Sequence; identical to SEQ ID NO: 43
  Synthetic

SEQ ID NO: 7004 - protein, 334 aa, Artificial Sequence; identical to SEQ ID NO: 31
  Synthetic

SEQ ID NO: 7005 - protein, 334 aa, Artificial Sequence; identical to SEQ ID NO: 29
  Synthetic

SEQ ID NO: 7006 - protein, 334 aa, Artificial Sequence; identical to SEQ ID NO: 157
  Synthetic

SEQ ID NO: 7007 - protein, 334 aa, Artificial Sequence; identical to SEQ ID NO: 153
  Synthetic

SEQ ID NO: 7008 - protein, 334 aa, Artificial Sequence; identical to SEQ ID NO: 101
  Synthetic

SEQ ID NO: 7009 - protein, 334 aa, Artificial Sequence; identical to SEQ ID NO: 44
  Synthetic

SEQ ID NO: 7010 - protein, 334 aa, Artificial Sequence; identical to SEQ ID NO: 306
  Synthetic
